United States Patent 11,174,469 (MATERIALS AND METHODS FOR TREATMENT OF AMYOTROPHIC LATERAL SCLEROSIS (ALS) AND OTHER RELATED DISORDERS) - sequence listing, part 2

SEQ ID NO: 7406 - DNA, 20 bp, Artificial Sequence
  Description of Artificial Sequence: Synthetic oligonucleotide
  Target: SOD1; (-) strand; PAM type: NRG; PAM sequence: AGG
gggcgacccgctcctagcaa

SEQ ID NO: 7407 - DNA, 20 bp, Artificial Sequence
  Description of Artificial Sequence: Synthetic oligonucleotide
  Target: SOD1; (-) strand; PAM type: NRG; PAM sequence: AAG
cgggcgacccgctcctagca

SEQ ID NO: 7408 - DNA, 20 bp, Artificial Sequence
  Description of Artificial Sequence: Synthetic oligonucleotide
  Target: SOD1; (-) strand; PAM type: NRG; PAM sequence: TAG
cctggcgggcgacccgctcc

SEQ ID NO: 7409 - DNA, 20 bp, Artificial Sequence
  Description of Artificial Sequence: Synthetic oligonucleotide
  Target: SOD1; (-) strand; PAM type: NRG; PAM sequence: GGG
gggcggccccgaggcctggc

SEQ ID NO: 7410 - DNA, 20 bp, Artificial Sequence
  Description of Artificial Sequence: Synthetic oligonucleotide
  Target: SOD1; (-) strand; PAM type: NRG; PAM sequence: CGG
agggcggccccgaggcctgg

SEQ ID NO: 7411 - DNA, 20 bp, Artificial Sequence
  Description of Artificial Sequence: Synthetic oligonucleotide
  Target: SOD1; (-) strand; PAM type: NRG; PAM sequence: TGG
accagggcggccccgaggcc

SEQ ID NO: 7412 - DNA, 20 bp, Artificial Sequence
  Description of Artificial Sequence: Synthetic oligonucleotide
  Target: SOD1; (-) strand; PAM type: NRG; PAM sequence: AGG
gctggaccagggcggccccg

SEQ ID NO: 7413 - DNA, 20 bp, Artificial Sequence
  Description of Artificial Sequence: Synthetic oligonucleotide
  Target: SOD1; (-) strand; PAM type: NRG; PAM sequence: GAG
cgctggaccagggcggcccc

SEQ ID NO: 7414 - DNA, 20 bp, Artificial Sequence
  Description of Artificial Sequence: Synthetic oligonucleotide
  Target: SOD1; (-) strand; PAM type: NRG; PAM sequence: CGG
gaccgggcgctggaccaggg

SEQ ID NO: 7415 - DNA, 20 bp, Artificial Sequence
  Description of Artificial Sequence: Synthetic oligonucleotide
  Target: SOD1; (-) strand; PAM type: NRG; PAM sequence: GGG
cgggaccgggcgctggacca

SEQ ID NO: 7416 - DNA, 20 bp, Artificial Sequence
  Description of Artificial Sequence: Synthetic oligonucleotide
  Target: SOD1; (-) strand; PAM type: NRG; PAM sequence: AGG
ccgggaccgggcgctggacc

SEQ ID NO: 7417 - DNA, 20 bp, Artificial Sequence
  Description of Artificial Sequence: Synthetic oligonucleotide
  Target: SOD1; (-) strand; PAM type: NRG; PAM sequence: CAG
gccgggaccgggcgctggac

SEQ ID NO: 7418 - DNA, 20 bp, Artificial Sequence
  Description of Artificial Sequence: Synthetic oligonucleotide
  Target: SOD1; (-) strand; PAM type: NRG; PAM sequence: TGG
cacgggccgggaccgggcgc

SEQ ID NO: 7419 - DNA, 20 bp, Artificial Sequence
  Description of Artificial Sequence: Synthetic oligonucleotide
  Target: SOD1; (-) strand; PAM type: NRG; PAM sequence: GGG
gggcggcacgggccgggacc

SEQ ID NO: 7420 - DNA, 20 bp, Artificial Sequence
  Description of Artificial Sequence: Synthetic oligonucleotide
  Target: SOD1; (-) strand; PAM type: NRG; PAM sequence: CGG
cgggcggcacgggccgggac

SEQ ID NO: 7421 - DNA, 20 bp, Artificial Sequence
  Description of Artificial Sequence: Synthetic oligonucleotide
  Target: SOD1; (-) strand; PAM type: NRG; PAM sequence: GGG
ccgaccgggcggcacgggcc

SEQ ID NO: 7422 - DNA, 20 bp, Artificial Sequence
  Description of Artificial Sequence: Synthetic oligonucleotide
  Target: SOD1; (-) strand; PAM type: NRG; PAM sequence: CGG
accgaccgggcggcacgggc

SEQ ID NO: 7423 - DNA, 20 bp, Artificial Sequence
  Description of Artificial Sequence: Synthetic oligonucleotide
  Target: SOD1; (-) strand; PAM type: NRG; PAM sequence: GGG
aggcaccgaccgggcggcac

SEQ ID NO: 7424 - DNA, 20 bp, Artificial Sequence
  Description of Artificial Sequence: Synthetic oligonucleotide
  Target: SOD1; (-) strand; PAM type: NRG; PAM sequence: CGG
aaggcaccgaccgggcggca

SEQ ID NO: 7425 - DNA, 20 bp, Artificial Sequence
  Description of Artificial Sequence: Synthetic oligonucleotide
  Target: SOD1; (-) strand; PAM type: NRG; PAM sequence: CGG
gggcgaaggcaccgaccggg

SEQ ID NO: 7426 - DNA, 20 bp, Artificial Sequence
  Description of Artificial Sequence: Synthetic oligonucleotide
  Target: SOD1; (-) strand; PAM type: NRG; PAM sequence: GGG
tgggggcgaaggcaccgacc

SEQ ID NO: 7427 - DNA, 20 bp, Artificial Sequence
  Description of Artificial Sequence: Synthetic oligonucleotide
  Target: SOD1; (-) strand; PAM type: NRG; PAM sequence: CGG
ctgggggcgaaggcaccgac

SEQ ID NO: 7428 - DNA, 20 bp, Artificial Sequence
  Description of Artificial Sequence: Synthetic oligonucleotide
  Target: SOD1; (-) strand; PAM type: NRG; PAM sequence: AGG
caccgcaccgctgggggcga

SEQ ID NO: 7429 - DNA, 20 bp, Artificial Sequence
  Description of Artificial Sequence: Synthetic oligonucleotide
  Target: SOD1; (-) strand; PAM type: NRG; PAM sequence: AAG
gcaccgcaccgctgggggcg

SEQ ID NO: 7430 - DNA, 20 bp, Artificial Sequence
  Description of Artificial Sequence: Synthetic oligonucleotide
  Target: SOD1; (-) strand; PAM type: NRG; PAM sequence: GGG
cttgggcaccgcaccgctgg

SEQ ID NO: 7431 - DNA, 20 bp, Artificial Sequence
  Description of Artificial Sequence: Synthetic oligonucleotide
  Target: SOD1; (-) strand; PAM type: NRG; PAM sequence: GGG
acttgggcaccgcaccgctg

SEQ ID NO: 7432 - DNA, 20 bp, Artificial Sequence
  Description of Artificial Sequence: Synthetic oligonucleotide
  Target: SOD1; (-) strand; PAM type: NRG; PAM sequence: GGG
cacttgggcaccgcaccgct

SEQ ID NO: 7433 - DNA, 20 bp, Artificial Sequence
  Description of Artificial Sequence: Synthetic oligonucleotide
  Target: SOD1; (-) strand; PAM type: NRG; PAM sequence: TGG
gcacttgggcaccgcaccgc

SEQ ID NO: 7434 - DNA, 20 bp, Artificial Sequence
  Description of Artificial Sequence: Synthetic oligonucleotide
  Target: SOD1; (-) strand; PAM type: NRG; PAM sequence: GGG
cgcccggtgactcagcactt

SEQ ID NO: 7435 - DNA, 20 bp, Artificial Sequence
  Description of Artificial Sequence: Synthetic oligonucleotide
  Target: SOD1; (-) strand; PAM type: NRG; PAM sequence: TGG
ccgcccggtgactcagcact

SEQ ID NO: 7436 - DNA, 20 bp, Artificial Sequence
  Description of Artificial Sequence: Synthetic oligonucleotide
  Target: SOD1; (-) strand; PAM type: NRG; PAM sequence: CAG
cccgggcccgcccggtgact

SEQ ID NO: 7437 - DNA, 20 bp, Artificial Sequence
  Description of Artificial Sequence: Synthetic oligonucleotide
  Target: SOD1; (-) strand; PAM type: NRG; PAM sequence: CGG
gccccgcgcccgggcccgcc

SEQ ID NO: 7438 - DNA, 20 bp, Artificial Sequence
  Description of Artificial Sequence: Synthetic oligonucleotide
  Target: SOD1; (-) strand; PAM type: NRG; PAM sequence: GGG
cggtcccacgccccgcgccc

SEQ ID NO: 7439 - DNA, 20 bp, Artificial Sequence
  Description of Artificial Sequence: Synthetic oligonucleotide
  Target: SOD1; (-) strand; PAM type: NRG; PAM sequence: CGG
tcggtcccacgccccgcgcc

SEQ ID NO: 7440 - DNA, 20 bp, Artificial Sequence
  Description of Artificial Sequence: Synthetic oligonucleotide
  Target: SOD1; (-) strand; PAM type: NRG; PAM sequence: CGG
gcccagccccgcggcggcct

SEQ ID NO: 7441 - DNA, 20 bp, Artificial Sequence
  Description of Artificial Sequence: Synthetic oligonucleotide
  Target: SOD1; (-) strand; PAM type: NRG; PAM sequence: CGG
gcgcaggcccagccccgcgg

SEQ ID NO: 7442 - DNA, 20 bp, Artificial Sequence
  Description of Artificial Sequence: Synthetic oligonucleotide
  Target: SOD1; (-) strand; PAM type: NRG; PAM sequence: CGG
cacgcgcaggcccagccccg

SEQ ID NO: 7443 - DNA, 20 bp, Artificial Sequence
  Description of Artificial Sequence: Synthetic oligonucleotide
  Target: SOD1; (-) strand; PAM type: NRG; PAM sequence: CAG
gctcccgccacgcgcaggcc

SEQ ID NO: 7444 - DNA, 20 bp, Artificial Sequence
  Description of Artificial Sequence: Synthetic oligonucleotide
  Target: SOD1; (-) strand; PAM type: NRG; PAM sequence: AGG
cccgcgctcccgccacgcgc

SEQ ID NO: 7445 - DNA, 20 bp, Artificial Sequence
  Description of Artificial Sequence: Synthetic oligonucleotide
  Target: SOD1; (-) strand; PAM type: NRG; PAM sequence: CAG
ccccgcgctcccgccacgcg

SEQ ID NO: 7446 - DNA, 20 bp, Artificial Sequence
  Description of Artificial Sequence: Synthetic oligonucleotide
  Target: SOD1; (-) strand; PAM type: NRG; PAM sequence: CGG
ccccgcccctccccggcccg

SEQ ID NO: 7447 - DNA, 20 bp, Artificial Sequence
  Description of Artificial Sequence: Synthetic oligonucleotide
  Target: SOD1; (-) strand; PAM type: NRG; PAM sequence: CGG
cgcccgcccccgcccctccc

SEQ ID NO: 7448 - DNA, 20 bp, Artificial Sequence
  Description of Artificial Sequence: Synthetic oligonucleotide
  Target: SOD1; (-) strand; PAM type: NRG; PAM sequence: CAG
ggcccaaggaccacagaggg

SEQ ID NO: 7449 - DNA, 20 bp, Artificial Sequence
  Description of Artificial Sequence: Synthetic oligonucleotide
  Target: SOD1; (-) strand; PAM type: NRG; PAM sequence: GGG
ggcggcccaaggaccacaga

SEQ ID NO: 7450 - DNA, 20 bp, Artificial Sequence
  Description of Artificial Sequence: Synthetic oligonucleotide
  Target: SOD1; (-) strand; PAM type: NRG; PAM sequence: AGG
cggcggcccaaggaccacag

SEQ ID NO: 7451 - DNA, 20 bp, Artificial Sequence
  Description of Artificial Sequence: Synthetic oligonucleotide
  Target: SOD1; (-) strand; PAM type: NRG; PAM sequence: GAG
gcggcggcccaaggaccaca

SEQ ID NO: 7452 - DNA, 20 bp, Artificial Sequence
  Description of Artificial Sequence: Synthetic oligonucleotide
  Target: SOD1; (-) strand; PAM type: NRG; PAM sequence: CAG
cggcggcggcccaaggacca

SEQ ID NO: 7453 - DNA, 20 bp, Artificial Sequence
  Description of Artificial Sequence: Synthetic oligonucleotide
  Target: SOD1; (-) strand; PAM type: NRG; PAM sequence: AGG
agacccgcggcggcggccca

SEQ ID NO: 7454 - DNA, 20 bp, Artificial Sequence
  Description of Artificial Sequence: Synthetic oligonucleotide
  Target: SOD1; (-) strand; PAM type: NRG; PAM sequence: AAG
cagacccgcggcggcggccc

SEQ ID NO: 7455 - DNA, 20 bp, Artificial Sequence
  Description of Artificial Sequence: Synthetic oligonucleotide
  Target: SOD1; (-) strand; PAM type: NRG; PAM sequence: CGG
ccacgacagacccgcggcgg

SEQ ID NO: 7456 - DNA, 20 bp, Artificial Sequence
  Description of Artificial Sequence: Synthetic oligonucleotide
  Target: SOD1; (-) strand; PAM type: NRG; PAM sequence: CGG
gcaccacgacagacccgcgg

SEQ ID NO: 7457 - DNA, 20 bp, Artificial Sequence
  Description of Artificial Sequence: Synthetic oligonucleotide
  Target: SOD1; (-) strand; PAM type: NRG; PAM sequence: CGG
caggcaccacgacagacccg

SEQ ID NO: 7458 - DNA, 20 bp, Artificial Sequence
  Description of Artificial Sequence: Synthetic oligonucleotide
  Target: SOD1; (-) strand; PAM type: NRG; PAM sequence: CAG
agccgctccaggcaccacga

SEQ ID NO: 7459 - DNA, 20 bp, Artificial Sequence
  Description of Artificial Sequence: Synthetic oligonucleotide
  Target: SOD1; (-) strand; PAM type: NRG; PAM sequence: AGG
gggacgagcacagccgctcc

SEQ ID NO: 7460 - DNA, 20 bp, Artificial Sequence
  Description of Artificial Sequence: Synthetic oligonucleotide
  Target: SOD1; (-) strand; PAM type: NRG; PAM sequence: CAG
agggacgagcacagccgctc

SEQ ID NO: 7461 - DNA, 20 bp, Artificial Sequence
  Description of Artificial Sequence: Synthetic oligonucleotide
  Target: SOD1; (-) strand; PAM type: NRG; PAM sequence: CAG
ggccaagcaagggacgagca

SEQ ID NO: 7462 - DNA, 20 bp, Artificial Sequence
  Description of Artificial Sequence: Synthetic oligonucleotide
  Target: SOD1; (-) strand; PAM type: NRG; PAM sequence: GAG
aacacggccaagcaagggac

SEQ ID NO: 7463 - DNA, 20 bp, Artificial Sequence
  Description of Artificial Sequence: Synthetic oligonucleotide
  Target: SOD1; (-) strand; PAM type: NRG; PAM sequence: GGG
acgagaacacggccaagcaa

SEQ ID NO: 7464 - DNA, 20 bp, Artificial Sequence
  Description of Artificial Sequence: Synthetic oligonucleotide
  Target: SOD1; (-) strand; PAM type: NRG; PAM sequence: AGG
aacgagaacacggccaagca

SEQ ID NO: 7465 - DNA, 20 bp, Artificial Sequence
  Description of Artificial Sequence: Synthetic oligonucleotide
  Target: SOD1; (-) strand; PAM type: NRG; PAM sequence: AAG
gaacgagaacacggccaagc

SEQ ID NO: 7466 - DNA, 20 bp, Artificial Sequence
  Description of Artificial Sequence: Synthetic oligonucleotide
  Target: SOD1; (-) strand; PAM type: NRG; PAM sequence: AAG
tcaggaacgagaacacggcc

SEQ ID NO: 7467 - DNA, 20 bp, Artificial Sequence
  Description of Artificial Sequence: Synthetic oligonucleotide
  Target: SOD1; (-) strand; PAM type: NRG; PAM sequence: CGG
gaccctcaggaacgagaaca

SEQ ID NO: 7468 - DNA, 20 bp, Artificial Sequence
  Description of Artificial Sequence: Synthetic oligonucleotide
  Target: SOD1; (-) strand; PAM type: NRG; PAM sequence: GAG
tccgcgggaccctcaggaac

SEQ ID NO: 7469 - DNA, 20 bp, Artificial Sequence
  Description of Artificial Sequence: Synthetic oligonucleotide
  Target: SOD1; (-) strand; PAM type: NRG; PAM sequence: AGG
tcggtgtccgcgggaccctc

SEQ ID NO: 7470 - DNA, 20 bp, Artificial Sequence
  Description of Artificial Sequence: Synthetic oligonucleotide
  Target: SOD1; (-) strand; PAM type: NRG; PAM sequence: CAG
ctcggtgtccgcgggaccct

SEQ ID NO: 7471 - DNA, 20 bp, Artificial Sequence
  Description of Artificial Sequence: Synthetic oligonucleotide
  Target: SOD1; (-) strand; PAM type: NRG; PAM sequence: GGG
ctgcgccactcggtgtccgc

SEQ ID NO: 7472 - DNA, 20 bp, Artificial Sequence
  Description of Artificial Sequence: Synthetic oligonucleotide
  Target: SOD1; (-) strand; PAM type: NRG; PAM sequence: CGG
actgcgccactcggtgtccg

SEQ ID NO: 7473 - DNA, 20 bp, Artificial Sequence
  Description of Artificial Sequence: Synthetic oligonucleotide
  Target: SOD1; (-) strand; PAM type: NRG; PAM sequence: CGG
gggcctggcactgcgccact

SEQ ID NO: 7474 - DNA, 20 bp, Artificial Sequence
  Description of Artificial Sequence: Synthetic oligonucleotide
  Target: SOD1; (-) strand; PAM type: NRG; PAM sequence: TGG
cgccatccccgggctgggcc

SEQ ID NO: 7475 - DNA, 20 bp, Artificial Sequence
  Description of Artificial Sequence: Synthetic oligonucleotide
  Target: SOD1; (-) strand; PAM type: NRG; PAM sequence: GGG
gcagtcgccatccccgggct

SEQ ID NO: 7476 - DNA, 20 bp, Artificial Sequence
  Description of Artificial Sequence: Synthetic oligonucleotide
  Target: SOD1; (-) strand; PAM type: NRG; PAM sequence: TGG
cgcagtcgccatccccgggc

SEQ ID NO: 7477 - DNA, 20 bp, Artificial Sequence
  Description of Artificial Sequence: Synthetic oligonucleotide
  Target: SOD1; (-) strand; PAM type: NRG; PAM sequence: GGG
caggcgcagtcgccatcccc

SEQ ID NO: 7478 - DNA, 20 bp, Artificial Sequence
  Description of Artificial Sequence: Synthetic oligonucleotide
  Target: SOD1; (-) strand; PAM type: NRG; PAM sequence: CGG
ccaggcgcagtcgccatccc

SEQ ID NO: 7479 - DNA, 20 bp, Artificial Sequence
  Description of Artificial Sequence: Synthetic oligonucleotide
  Target: SOD1; (-) strand; PAM type: NRG; PAM sequence: CAG
acaccaggcgggcccaggcg

SEQ ID NO: 7480 - DNA, 20 bp, Artificial Sequence
  Description of Artificial Sequence: Synthetic oligonucleotide
  Target: SOD1; (-) strand; PAM type: NRG; PAM sequence: AGG
cgaagacaccaggcgggccc

SEQ ID NO: 7481 - DNA, 20 bp, Artificial Sequence
  Description of Artificial Sequence: Synthetic oligonucleotide
  Target: SOD1; (-) strand; PAM type: NRG; PAM sequence: CAG
gcgaagacaccaggcgggcc

SEQ ID NO: 7482 - DNA, 20 bp, Artificial Sequence
  Description of Artificial Sequence: Synthetic oligonucleotide
  Target: SOD1; (-) strand; PAM type: NRG; PAM sequence: GGG
gggatgcgaagacaccaggc

SEQ ID NO: 7483 - DNA, 20 bp, Artificial Sequence
  Description of Artificial Sequence: Synthetic oligonucleotide
  Target: SOD1; (-) strand; PAM type: NRG; PAM sequence: CGG
agggatgcgaagacaccagg

SEQ ID NO: 7484 - DNA, 20 bp, Artificial Sequence
  Description of Artificial Sequence: Synthetic oligonucleotide
  Target: SOD1; (-) strand; PAM type: NRG; PAM sequence: AGG
gagagggatgcgaagacacc

SEQ ID NO: 7485 - DNA, 20 bp, Artificial Sequence
  Description of Artificial Sequence: Synthetic oligonucleotide
  Target: SOD1; (-) strand; PAM type: NRG; PAM sequence: CAG
ggagagggatgcgaagacac

SEQ ID NO: 7486 - DNA, 20 bp, Artificial Sequence
  Description of Artificial Sequence: Synthetic oligonucleotide
  Target: SOD1; (-) strand; PAM type: NRG; PAM sequence: AAG
ggaaagcggagagggatgcg

SEQ ID NO: 7487 - DNA, 20 bp, Artificial Sequence
  Description of Artificial Sequence: Synthetic oligonucleotide
  Target: SOD1; (-) strand; PAM type: NRG; PAM sequence: GGG
ctgaagccggaaagcggaga

SEQ ID NO: 7488 - DNA, 20 bp, Artificial Sequence
  Description of Artificial Sequence: Synthetic oligonucleotide
  Target: SOD1; (-) strand; PAM type: NRG; PAM sequence: AGG
gctgaagccggaaagcggag

SEQ ID NO: 7489 - DNA, 20 bp, Artificial Sequence
  Description of Artificial Sequence: Synthetic oligonucleotide
  Target: SOD1; (-) strand; PAM type: NRG; PAM sequence: GAG
cgctgaagccggaaagcgga

SEQ ID NO: 7490 - DNA, 20 bp, Artificial Sequence
  Description of Artificial Sequence: Synthetic oligonucleotide
  Target: SOD1; (-) strand; PAM type: NRG; PAM sequence: GAG
agcgctgaagccggaaagcg

SEQ ID NO: 7491 - DNA, 20 bp, Artificial Sequence
  Description of Artificial Sequence: Synthetic oligonucleotide
  Target: SOD1; (-) strand; PAM type: NRG; PAM sequence: CGG
agagcgctgaagccggaaag

SEQ ID NO: 7492 - DNA, 20 bp, Artificial Sequence
  Description of Artificial Sequence: Synthetic oligonucleotide
  Target: SOD1; (-) strand; PAM type: NRG; PAM sequence: AAG
cctagagcgctgaagccgga

SEQ ID NO: 7493 - DNA, 20 bp, Artificial Sequence
  Description of Artificial Sequence: Synthetic oligonucleotide
  Target: SOD1; (-) strand; PAM type: NRG; PAM sequence: CGG
ctgacctagagcgctgaagc

SEQ ID NO: 7494 - DNA, 20 bp, Artificial Sequence
  Description of Artificial Sequence: Synthetic oligonucleotide
  Target: SOD1; (-) strand; PAM type: NRG; PAM sequence: AAG
ctccctgacctagagcgctg

SEQ ID NO: 7495 - DNA, 20 bp, Artificial Sequence
  Description of Artificial Sequence: Synthetic oligonucleotide
  Target: SOD1; (-) strand; PAM type: NRG; PAM sequence: GAG
agcgaagactccctgaccta

SEQ ID NO: 7496 - DNA, 20 bp, Artificial Sequence
  Description of Artificial Sequence: Synthetic oligonucleotide
  Target: SOD1; (-) strand; PAM type: NRG; PAM sequence: TAG
aaagcgaagactccctgacc

SEQ ID NO: 7497 - DNA, 20 bp, Artificial Sequence
  Description of Artificial Sequence: Synthetic oligonucleotide
  Target: SOD1; (-) strand; PAM type: NRG; PAM sequence: AAG
cttagagctgtacaaaagcg

SEQ ID NO: 7498 - DNA, 20 bp, Artificial Sequence
  Description of Artificial Sequence: Synthetic oligonucleotide
  Target: SOD1; (-) strand; PAM type: NRG; PAM sequence: AAG
ctagccttagagctgtacaa

SEQ ID NO: 7499 - DNA, 20 bp, Artificial Sequence
  Description of Artificial Sequence: Synthetic oligonucleotide
  Target: SOD1; (-) strand; PAM type: NRG; PAM sequence: GAG
aaaaaccattcctagcctta

SEQ ID NO: 7500 - DNA, 20 bp, Artificial Sequence
  Description of Artificial Sequence: Synthetic oligonucleotide
  Target: SOD1; (-) strand; PAM type: NRG; PAM sequence: TAG
ataaaaaccattcctagcct

SEQ ID NO: 7501 - DNA, 20 bp, Artificial Sequence
  Description of Artificial Sequence: Synthetic oligonucleotide
  Target: SOD1; (-) strand; PAM type: NRG; PAM sequence: TAG
aaaaatataaaaaccattcc

SEQ ID NO: 7502 - DNA, 20 bp, Artificial Sequence
  Description of Artificial Sequence: Synthetic oligonucleotide
  Target: SOD1; (-) strand; PAM type: NRG; PAM sequence: AAG
ttgcgtatttttgttttcca

SEQ ID NO: 7503 - DNA, 20 bp, Artificial Sequence
  Description of Artificial Sequence: Synthetic oligonucleotide
  Target: SOD1; (-) strand; PAM type: NRG; PAM sequence: CGG
cctgcaaagtgtcacacaaa

SEQ ID NO: 7504 - DNA, 20 bp, Artificial Sequence
  Description of Artificial Sequence: Synthetic oligonucleotide
  Target: SOD1; (-) strand; PAM type: NRG; PAM sequence: AAG
ggccagcaaacttccctgca

SEQ ID NO: 7505 - DNA, 20 bp, Artificial Sequence
  Description of Artificial Sequence: Synthetic oligonucleotide
  Target: SOD1; (-) strand; PAM type: NRG; PAM sequence: CAG
tcatgacctagaacagaggc

SEQ ID NO: 7506 - DNA, 20 bp, Artificial Sequence
  Description of Artificial Sequence: Synthetic oligonucleotide
  Target: SOD1; (-) strand; PAM type: NRG; PAM sequence: AGG
ccaatcatgacctagaacag

SEQ ID NO: 7507 - DNA, 20 bp, Artificial Sequence
  Description of Artificial Sequence: Synthetic oligonucleotide
  Target: SOD1; (-) strand; PAM type: NRG; PAM sequence: GAG
cccaatcatgacctagaaca

SEQ ID NO: 7508 - DNA, 20 bp, Artificial Sequence
  Description of Artificial Sequence: Synthetic oligonucleotide
  Target: SOD1; (-) strand; PAM type: NRG; PAM sequence: CAG
agcccaatcatgacctagaa

SEQ ID NO: 7509 - DNA, 20 bp, Artificial Sequence
  Description of Artificial Sequence: Synthetic oligonucleotide
  Target: SOD1; (-) strand; PAM type: NRG; PAM sequence: TAG
cttgcagcccaatcatgacc

SEQ ID NO: 7510 - DNA, 20 bp, Artificial Sequence
  Description of Artificial Sequence: Synthetic oligonucleotide
  Target: SOD1; (-) strand; PAM type: NRG; PAM sequence: CAG
ggctaccttctctgcccttg

SEQ ID NO: 7511 - DNA, 20 bp, Artificial Sequence
  Description of Artificial Sequence: Synthetic oligonucleotide
  Target: SOD1; (-) strand; PAM type: NRG; PAM sequence: AGG
aggaaaaggacctctgttca

SEQ ID NO: 7512 - DNA, 20 bp, Artificial Sequence
  Description of Artificial Sequence: Synthetic oligonucleotide
  Target: SOD1; (-) strand; PAM type: NRG; PAM sequence: AAG
gaggaaaaggacctctgttc

SEQ ID NO: 7513 - DNA, 20 bp, Artificial Sequence
  Description of Artificial Sequence: Synthetic oligonucleotide
  Target: SOD1; (-) strand; PAM type: NRG; PAM sequence: AGG
cggagcttaggaggaggaaa

SEQ ID NO: 7514 - DNA, 20 bp, Artificial Sequence
  Description of Artificial Sequence: Synthetic oligonucleotide
  Target: SOD1; (-) strand; PAM type: NRG; PAM sequence: AAG
ccggagcttaggaggaggaa

SEQ ID NO: 7515 - DNA, 20 bp, Artificial Sequence
  Description of Artificial Sequence: Synthetic oligonucleotide
  Target: SOD1; (-) strand; PAM type: NRG; PAM sequence: AGG
ggctcccggagcttaggagg

SEQ ID NO: 7516 - DNA, 20 bp, Artificial Sequence
  Description of Artificial Sequence: Synthetic oligonucleotide
  Target: SOD1; (-) strand; PAM type: NRG; PAM sequence: GAG
tggctcccggagcttaggag

SEQ ID NO: 7517 - DNA, 20 bp, Artificial Sequence
  Description of Artificial Sequence: Synthetic oligonucleotide
  Target: SOD1; (-) strand; PAM type: NRG; PAM sequence: AGG
tctggctcccggagcttagg

SEQ ID NO: 7518 - DNA, 20 bp, Artificial Sequence
  Description of Artificial Sequence: Synthetic oligonucleotide
  Target: SOD1; (-) strand; PAM type: NRG; PAM sequence: GAG
ctctggctcccggagcttag

SEQ ID NO: 7519 - DNA, 20 bp, Artificial Sequence
  Description of Artificial Sequence: Synthetic oligonucleotide
  Target: SOD1; (-) strand; PAM type: NRG; PAM sequence: AGG
acctctggctcccggagctt

SEQ ID NO: 7520 - DNA, 20 bp, Artificial Sequence
  Description of Artificial Sequence: Synthetic oligonucleotide
  Target: SOD1; (-) strand; PAM type: NRG; PAM sequence: TAG
aacctctggctcccggagct

SEQ ID NO: 7521 - DNA, 20 bp, Artificial Sequence
  Description of Artificial Sequence: Synthetic oligonucleotide
  Target: SOD1; (-) strand; PAM type: NRG; PAM sequence: GAG
agttaaacctctggctcccg

SEQ ID NO: 7522 - DNA, 20 bp, Artificial Sequence
  Description of Artificial Sequence: Synthetic oligonucleotide
  Target: SOD1; (-) strand; PAM type: NRG; PAM sequence: CGG
tcagttaaacctctggctcc

SEQ ID NO: 7523 - DNA, 20 bp, Artificial Sequence
  Description of Artificial Sequence: Synthetic oligonucleotide
  Target: SOD1; (-) strand; PAM type: NRG; PAM sequence: TGG
aaaagggtcagttaaacctc

SEQ ID NO: 7524 - DNA, 20 bp, Artificial Sequence
  Description of Artificial Sequence: Synthetic oligonucleotide
  Target: SOD1; (-) strand; PAM type: NRG; PAM sequence: CAG
tcaaaaatccccaaaagggt

SEQ ID NO: 7525 - DNA, 20 bp, Artificial Sequence
  Description of Artificial Sequence: Synthetic oligonucleotide
  Target: SOD1; (-) strand; PAM type: NRG; PAM sequence: GGG
gccctcaaaaatccccaaaa

SEQ ID NO: 7526 - DNA, 20 bp, Artificial Sequence
  Description of Artificial Sequence: Synthetic oligonucleotide
  Target: SOD1; (-) strand; PAM type: NRG; PAM sequence: AGG
tgccctcaaaaatccccaaa

SEQ ID NO: 7527 - DNA, 20 bp, Artificial Sequence
  Description of Artificial Sequence: Synthetic oligonucleotide
  Target: SOD1; (-) strand; PAM type: NRG; PAM sequence: AAG
ctgccctcaaaaatccccaa

SEQ ID NO: 7528 - DNA, 20 bp, Artificial Sequence
  Description of Artificial Sequence: Synthetic oligonucleotide
  Target: SOD1; (-) strand; PAM type: NRG; PAM sequence: AAG
ctaactgtgcacccaaagtt

SEQ ID NO: 7529 - DNA, 20 bp, Artificial Sequence
  Description of Artificial Sequence: Synthetic oligonucleotide
  Target: SOD1; (-) strand; PAM type: NRG; PAM sequence: AAG
ataagctaactgtgcaccca

SEQ ID NO: 7530 - DNA, 20 bp, Artificial Sequence
  Description of Artificial Sequence: Synthetic oligonucleotide
  Target: SOD1; (-) strand; PAM type: NRG; PAM sequence: AAG
ttttagtaagatcttcaaat

SEQ ID NO: 7531 - DNA, 20 bp, Artificial Sequence
  Description of Artificial Sequence: Synthetic oligonucleotide
  Target: SOD1; (-) strand; PAM type: NRG; PAM sequence: AAG
ggctctggtgtatttttagt

SEQ ID NO: 7532 - DNA, 20 bp, Artificial Sequence
  Description of Artificial Sequence: Synthetic oligonucleotide
  Target: SOD1; (-) strand; PAM type: NRG; PAM sequence: TAG
gttgggctctggtgtatttt

SEQ ID NO: 7533 - DNA, 20 bp, Artificial Sequence
  Description of Artificial Sequence: Synthetic oligonucleotide
  Target: SOD1; (-) strand; PAM type: NRG; PAM sequence: TGG
attggtcggaggttgggctc

SEQ ID NO: 7534 - DNA, 20 bp, Artificial Sequence
  Description of Artificial Sequence: Synthetic oligonucleotide
  Target: SOD1; (-) strand; PAM type: NRG; PAM sequence: GGG
gatgtaattggtcggaggtt

SEQ ID NO: 7535 - DNA, 20 bp, Artificial Sequence
  Description of Artificial Sequence: Synthetic oligonucleotide
  Target: SOD1; (-) strand; PAM type: NRG; PAM sequence: TGG
tgatgtaattggtcggaggt

SEQ ID NO: 7536 - DNA, 20 bp, Artificial Sequence
  Description of Artificial Sequence: Synthetic oligonucleotide
  Target: SOD1; (-) strand; PAM type: NRG; PAM sequence: AGG
gttttgatgtaattggtcgg

SEQ ID NO: 7537 - DNA, 20 bp, Artificial Sequence
  Description of Artificial Sequence: Synthetic oligonucleotide
  Target: SOD1; (-) strand; PAM type: NRG; PAM sequence: GAG
ggttttgatgtaattggtcg

SEQ ID NO: 7538 - DNA, 20 bp, Artificial Sequence
  Description of Artificial Sequence: Synthetic oligonucleotide
  Target: SOD1; (-) strand; PAM type: NRG; PAM sequence: CGG
caggttttgatgtaattggt

SEQ ID NO: 7539 - DNA, 20 bp, Artificial Sequence
  Description of Artificial Sequence: Synthetic oligonucleotide
  Target: SOD1; (-) strand; PAM type: NRG; PAM sequence: TGG
aggacaggttttgatgtaat

SEQ ID NO: 7540 - DNA, 20 bp, Artificial Sequence
  Description of Artificial Sequence: Synthetic oligonucleotide
  Target: SOD1; (-) strand; PAM type: NRG; PAM sequence: AGG
tactcaccctgcactaggac

SEQ ID NO: 7541 - DNA, 20 bp, Artificial Sequence
  Description of Artificial Sequence: Synthetic oligonucleotide
  Target: SOD1; (-) strand; PAM type: NRG; PAM sequence: CAG
atactcaccctgcactagga

SEQ ID NO: 7542 - DNA, 20 bp, Artificial Sequence
  Description of Artificial Sequence: Synthetic oligonucleotide
  Target: SOD1; (-) strand; PAM type: NRG; PAM sequence: AGG
agcaatactcaccctgcact

SEQ ID NO: 7543 - DNA, 20 bp, Artificial Sequence
  Description of Artificial Sequence: Synthetic oligonucleotide
  Target: SOD1; (-) strand; PAM type: NRG; PAM sequence: TAG
cagcaatactcaccctgcac

SEQ ID NO: 7544 - DNA, 20 bp, Artificial Sequence
  Description of Artificial Sequence: Synthetic oligonucleotide
  Target: SOD1; (-) strand; PAM type: NRG; PAM sequence: CAG
ttttggaaactttcaaaaaa

SEQ ID NO: 7545 - DNA, 20 bp, Artificial Sequence
  Description of Artificial Sequence: Synthetic oligonucleotide
  Target: SOD1; (-) strand; PAM type: NRG; PAM sequence: TGG
gtgcacatcaaaatcacttt

SEQ ID NO: 7546 - DNA, 20 bp, Artificial Sequence
  Description of Artificial Sequence: Synthetic oligonucleotide
  Target: SOD1; (-) strand; PAM type: NRG; PAM sequence: AGG
aaacgacagttctcaatcgt

SEQ ID NO: 7547 - DNA, 20 bp, Artificial Sequence
  Description of Artificial Sequence: Synthetic oligonucleotide
  Target: SOD1; (-) strand; PAM type: NRG; PAM sequence: TAG
caaacgacagttctcaatcg

SEQ ID NO: 7548 - DNA, 20 bp, Artificial Sequence
  Description of Artificial Sequence: Synthetic oligonucleotide
  Target: SOD1; (-) strand; PAM type: NRG; PAM sequence: CAG
cacccactgtcctcaaacga

SEQ ID NO: 7549 - DNA, 20 bp, Artificial Sequence
  Description of Artificial Sequence: Synthetic oligonucleotide
  Target: SOD1; (-) strand; PAM type: NRG; PAM sequence: AGG
ttcggtgtaatggaaactcc

SEQ ID NO: 7550 - DNA, 20 bp, Artificial Sequence
  Description of Artificial Sequence: Synthetic oligonucleotide
  Target: SOD1; (-) strand; PAM type: NRG; PAM sequence: CAG
attcggtgtaatggaaactc

SEQ ID NO: 7551 - DNA, 20 bp, Artificial Sequence
  Description of Artificial Sequence: Synthetic oligonucleotide
  Target: SOD1; (-) strand; PAM type: NRG; PAM sequence: TGG
taagtgccaattcggtgtaa

SEQ ID NO: 7552 - DNA, 20 bp, Artificial Sequence
  Description of Artificial Sequence: Synthetic oligonucleotide
  Target: SOD1; (-) strand; PAM type: NRG; PAM sequence: CGG
acagttattaagtgccaatt

SEQ ID NO: 7553 - DNA, 20 bp, Artificial Sequence
  Description of Artificial Sequence: Synthetic oligonucleotide
  Target: SOD1; (-) strand; PAM type: NRG; PAM sequence: AAG
atgctccgacaacagttatt

SEQ ID NO: 7554 - DNA, 20 bp, Artificial Sequence
  Description of Artificial Sequence: Synthetic oligonucleotide
  Target: SOD1; (-) strand; PAM type: NRG; PAM sequence: CAG
cttaagaaatgctccgacaa

SEQ ID NO: 7555 - DNA, 20 bp, Artificial Sequence
  Description of Artificial Sequence: Synthetic oligonucleotide
  Target: SOD1; (-) strand; PAM type: NRG; PAM sequence: AAG
actttacgaaaatgtggctt

SEQ ID NO: 7556 - DNA, 20 bp, Artificial Sequence
  Description of Artificial Sequence: Synthetic oligonucleotide
  Target: SOD1; (-) strand; PAM type: NRG; PAM sequence: TGG
aaagccactttacgaaaatg

SEQ ID NO: 7557 - DNA, 20 bp, Artificial Sequence
  Description of Artificial Sequence: Synthetic oligonucleotide
  Target: SOD1; (-) strand; PAM type: NRG; PAM sequence: AAG
ctactggcagagcaatttta

SEQ ID NO: 7558 - DNA, 20 bp, Artificial Sequence
  Description of Artificial Sequence: Synthetic oligonucleotide
  Target: SOD1; (-) strand; PAM type: NRG; PAM sequence: GAG
tagcaacctgcctactggca

SEQ ID NO: 7559 - DNA, 20 bp, Artificial Sequence
  Description of Artificial Sequence: Synthetic oligonucleotide
  Target: SOD1; (-) strand; PAM type: NRG; PAM sequence: CAG
cttagcaacctgcctactgg

SEQ ID NO: 7560 - DNA, 20 bp, Artificial Sequence
  Description of Artificial Sequence: Synthetic oligonucleotide
  Target: SOD1; (-) strand; PAM type: NRG; PAM sequence: TGG
catcttagcaacctgcctac

SEQ ID NO: 7561 - DNA, 20 bp, Artificial Sequence
  Description of Artificial Sequence: Synthetic oligonucleotide
  Target: SOD1; (-) strand; PAM type: NRG; PAM sequence: TAG
aagtttgtctctgaccatct

SEQ ID NO: 7562 - DNA, 20 bp, Artificial Sequence
  Description of Artificial Sequence: Synthetic oligonucleotide
  Target: SOD1; (-) strand; PAM type: NRG; PAM sequence: AAG
attttacaagagtcgttcag

SEQ ID NO: 7563 - DNA, 20 bp, Artificial Sequence
  Description of Artificial Sequence: Synthetic oligonucleotide
  Target: SOD1; (-) strand; PAM type: NRG; PAM sequence: CAG
tatattttacaagagtcgtt

SEQ ID NO: 7564 - DNA, 20 bp, Artificial Sequence
  Description of Artificial Sequence: Synthetic oligonucleotide
  Target: SOD1; (-) strand; PAM type: NRG; PAM sequence: GAG
tatttctgtatattttacaa

SEQ ID NO: 7565 - DNA, 20 bp, Artificial Sequence
  Description of Artificial Sequence: Synthetic oligonucleotide
  Target: SOD1; (-) strand; PAM type: NRG; PAM sequence: AAG
aatatttctgtatattttac

SEQ ID NO: 7566 - DNA, 20 bp, Artificial Sequence
  Description of Artificial Sequence: Synthetic oligonucleotide
  Target: SOD1; (-) strand; PAM type: NRG; PAM sequence: AAG
ttttgtaattttactgataa

SEQ ID NO: 7567 - DNA, 20 bp, Artificial Sequence
  Description of Artificial Sequence: Synthetic oligonucleotide
  Target: SOD1; (-) strand; PAM type: NRG; PAM sequence: AAG
tctggggacagtgttatcac

SEQ ID NO: 7568 - DNA, 20 bp, Artificial Sequence
  Description of Artificial Sequence: Synthetic oligonucleotide
  Target: SOD1; (-) strand; PAM type: NRG; PAM sequence: CAG
cttcactaaggttctgggga

SEQ ID NO: 7569 - DNA, 20 bp, Artificial Sequence
  Description of Artificial Sequence: Synthetic oligonucleotide
  Target: SOD1; (-) strand; PAM type: NRG; PAM sequence: GGG
gtaacttcactaaggttctg

SEQ ID NO: 7570 - DNA, 20 bp, Artificial Sequence
  Description of Artificial Sequence: Synthetic oligonucleotide
  Target: SOD1; (-) strand; PAM type: NRG; PAM sequence: GGG
ggtaacttcactaaggttct

SEQ ID NO: 7571 - DNA, 20 bp, Artificial Sequence
  Description of Artificial Sequence: Synthetic oligonucleotide
  Target: SOD1; (-) strand; PAM type: NRG; PAM sequence: TGG
tggtaacttcactaaggttc

SEQ ID NO: 7572 - DNA, 20 bp, Artificial Sequence
  Description of Artificial Sequence: Synthetic oligonucleotide
  Target: SOD1; (-) strand; PAM type: NRG; PAM sequence: AGG
accagttggtaacttcacta

SEQ ID NO: 7573 - DNA, 20 bp, Artificial Sequence
  Description of Artificial Sequence: Synthetic oligonucleotide
  Target: SOD1; (-) strand; PAM type: NRG; PAM sequence: AAG
caccagttggtaacttcact

SEQ ID NO: 7574 - DNA, 20 bp, Artificial Sequence
  Description of Artificial Sequence: Synthetic oligonucleotide
  Target: SOD1; (-) strand; PAM type: NRG; PAM sequence: TGG
agagaaaattttccaccagt

SEQ ID NO: 7575 - DNA, 20 bp, Artificial Sequence
  Description of Artificial Sequence: Synthetic oligonucleotide
  Target: SOD1; (-) strand; PAM type: NRG; PAM sequence: CAG
tgcaagagaaaattttccac

SEQ ID NO: 7576 - DNA, 20 bp, Artificial Sequence
  Description of Artificial Sequence: Synthetic oligonucleotide
  Target: SOD1; (-) strand; PAM type: NRG; PAM sequence: GAG
gatttttaagccgagtgcaa

SEQ ID NO: 7577 - DNA, 20 bp, Artificial Sequence
  Description of Artificial Sequence: Synthetic oligonucleotide
  Target: SOD1; (-) strand; PAM type: NRG; PAM sequence: AAG
atgatttttaagccgagtgc

SEQ ID NO: 7578 - DNA, 20 bp, Artificial Sequence
  Description of Artificial Sequence: Synthetic oligonucleotide
  Target: SOD1; (-) strand; PAM type: NRG; PAM sequence: GAG
tccctcatgatttttaagcc

SEQ ID NO: 7579 - DNA, 20 bp, Artificial Sequence
  Description of Artificial Sequence: Synthetic oligonucleotide
  Target: SOD1; (-) strand; PAM type: NRG; PAM sequence: AAG
aatattccctcatgattttt

SEQ ID NO: 7580 - DNA, 20 bp, Artificial Sequence
  Description of Artificial Sequence: Synthetic oligonucleotide
  Target: SOD1; (-) strand; PAM type: NRG; PAM sequence: TAG
aagactgaatctcattcgta

SEQ ID NO: 7581 - DNA, 20 bp, Artificial Sequence
  Description of Artificial Sequence: Synthetic oligonucleotide
  Target: SOD1; (-) strand; PAM type: NRG; PAM sequence: AAG
cgtttctgtaaaccccttta

SEQ ID NO: 7582 - DNA, 20 bp, Artificial Sequence
  Description of Artificial Sequence: Synthetic oligonucleotide
  Target: SOD1; (-) strand; PAM type: NRG; PAM sequence: CAG
atatatttcagacatttaca

SEQ ID NO: 7583 - DNA, 20 bp, Artificial Sequence
  Description of Artificial Sequence: Synthetic oligonucleotide
  Target: SOD1; (-) strand; PAM type: NRG; PAM sequence: CAG
tatctccctcacatatattt

SEQ ID NO: 7584 - DNA, 20 bp, Artificial Sequence
  Description of Artificial Sequence: Synthetic oligonucleotide
  Target: SOD1; (-) strand; PAM type: NRG; PAM sequence: AGG
tggagacctattaaagaaaa

SEQ ID NO: 7585 - DNA, 20 bp, Artificial Sequence
  Description of Artificial Sequence: Synthetic oligonucleotide
  Target: SOD1; (-) strand; PAM type: NRG; PAM sequence: AAG
ctggagacctattaaagaaa

SEQ ID NO: 7586 - DNA, 20 bp, Artificial Sequence
  Description of Artificial Sequence: Synthetic oligonucleotide
  Target: SOD1; (-) strand; PAM type: NRG; PAM sequence: AAG
gaaaatctggagacctatta

SEQ ID NO: 7587 - DNA, 20 bp, Artificial Sequence
  Description of Artificial Sequence: Synthetic oligonucleotide
  Target: SOD1; (-) strand; PAM type: NRG; PAM sequence: GAG
aaccttttccagaaaatctg

SEQ ID NO: 7588 - DNA, 20 bp, Artificial Sequence
  Description of Artificial Sequence: Synthetic oligonucleotide
  Target: SOD1; (-) strand; PAM type: NRG; PAM sequence: TGG
agaaccttttccagaaaatc

SEQ ID NO: 7589 - DNA, 20 bp, Artificial Sequence
  Description of Artificial Sequence: Synthetic oligonucleotide
  Target: SOD1; (-) strand; PAM type: NRG; PAM sequence: CAG
aaatgccaaagaaccttttc

SEQ ID NO: 7590 - DNA, 20 bp, Artificial Sequence
  Description of Artificial Sequence: Synthetic oligonucleotide
  Target: SOD1; (-) strand; PAM type: NRG; PAM sequence: AAG
caaaatggagtcaaatgcca

SEQ ID NO: 7591 - DNA, 20 bp, Artificial Sequence
  Description of Artificial Sequence: Synthetic oligonucleotide
  Target: SOD1; (-) strand; PAM type: NRG; PAM sequence: GAG
acaaatgaaacagcaaaatg

SEQ ID NO: 7592 - DNA, 20 bp, Artificial Sequence
  Description of Artificial Sequence: Synthetic oligonucleotide
  Target: SOD1; (-) strand; PAM type: NRG; PAM sequence: TGG
tgacaaatgaaacagcaaaa

SEQ ID NO: 7593 - DNA, 20 bp, Artificial Sequence
  Description of Artificial Sequence: Synthetic oligonucleotide
  Target: SOD1; (-) strand; PAM type: NRG; PAM sequence: CAG
aagaagtctgacaaatgaaa

SEQ ID NO: 7594 - DNA, 20 bp, Artificial Sequence
  Description of Artificial Sequence: Synthetic oligonucleotide
  Target: SOD1; (-) strand; PAM type: NRG; PAM sequence: AAG
aagtaaagagggacaaaaag

SEQ ID NO: 7595 - DNA, 20 bp, Artificial Sequence
  Description of Artificial Sequence: Synthetic oligonucleotide
  Target: SOD1; (-) strand; PAM type: NRG; PAM sequence: AAG
gagaagtaaagagggacaaa

SEQ ID NO: 7596 - DNA, 20 bp, Artificial Sequence
  Description of Artificial Sequence: Synthetic oligonucleotide
  Target: SOD1; (-) strand; PAM type: NRG; PAM sequence: GGG
tatgtggggagaagtaaaga

SEQ ID NO: 7597 - DNA, 20 bp, Artificial Sequence
  Description of Artificial Sequence: Synthetic oligonucleotide
  Target: SOD1; (-) strand; PAM type: NRG; PAM sequence: AGG
ttatgtggggagaagtaaag

SEQ ID NO: 7598 - DNA, 20 bp, Artificial Sequence
  Description of Artificial Sequence: Synthetic oligonucleotide
  Target: SOD1; (-) strand; PAM type: NRG; PAM sequence: GAG
attatgtggggagaagtaaa

SEQ ID NO: 7599 - DNA, 20 bp, Artificial Sequence
  Description of Artificial Sequence: Synthetic oligonucleotide
  Target: SOD1; (-) strand; PAM type: NRG; PAM sequence: AAG
gaattatgtggggagaagta

SEQ ID NO: 7600 - DNA, 20 bp, Artificial Sequence
  Description of Artificial Sequence: Synthetic oligonucleotide
  Target: SOD1; (-) strand; PAM type: NRG; PAM sequence: AAG
ctggtgaattatgtggggag

SEQ ID NO: 7601 - DNA, 20 bp, Artificial Sequence
  Description of Artificial Sequence: Synthetic oligonucleotide
  Target: SOD1; (-) strand; PAM type: NRG; PAM sequence: GAG
gtactggtgaattatgtggg

SEQ ID NO: 7602 - DNA, 20 bp, Artificial Sequence
  Description of Artificial Sequence: Synthetic oligonucleotide
  Target: SOD1; (-) strand; PAM type: NRG; PAM sequence: GGG
tagtactggtgaattatgtg

SEQ ID NO: 7603 - DNA, 20 bp, Artificial Sequence
  Description of Artificial Sequence: Synthetic oligonucleotide
  Target: SOD1; (-) strand; PAM type: NRG; PAM sequence: GGG
ctagtactggtgaattatgt

SEQ ID NO: 7604 - DNA, 20 bp, Artificial Sequence
  Description of Artificial Sequence: Synthetic oligonucleotide
  Target: SOD1; (-) strand; PAM type: NRG; PAM sequence: TGG
actagtactggtgaattatg

SEQ ID NO: 7605 - DNA, 20 bp, Artificial Sequence
  Description of Artificial Sequence: Synthetic oligonucleotide
  Target: SOD1; (-) strand; PAM type: NRG; PAM sequence: TGG
gaaaaacaaaacactagtac

SEQ ID NO: 7606 - DNA, 20 bp, Artificial Sequence
  Description of Artificial Sequence: Synthetic oligonucleotide
  Target: SOD1; (-) strand; PAM type: NRG; PAM sequence: TAG
tggtctgaaaaacaaaacac

SEQ ID NO: 7607 - DNA, 20 bp, Artificial Sequence
  Description of Artificial Sequence: Synthetic oligonucleotide
  Target: SOD1; (-) strand; PAM type: NRG; PAM sequence: TGG
ctgggcgacagagcgagact

SEQ ID NO: 7608 - DNA, 20 bp, Artificial Sequence
  Description of Artificial Sequence: Synthetic oligonucleotide
  Target: SOD1; (-) strand; PAM type: NRG; PAM sequence: GAG
tccagcctgggcgacagagc

SEQ ID NO: 7609 - DNA, 20 bp, Artificial Sequence
  Description of Artificial Sequence: Synthetic oligonucleotide
  Target: SOD1; (-) strand; PAM type: NRG; PAM sequence: GAG
gcactccagcctgggcgaca

SEQ ID NO: 7610 - DNA, 20 bp, Artificial Sequence
  Description of Artificial Sequence: Synthetic oligonucleotide
  Target: SOD1; (-) strand; PAM type: NRG; PAM sequence: CAG
ctgcactccagcctgggcga

SEQ ID NO: 7611 - DNA, 20 bp, Artificial Sequence
  Description of Artificial Sequence: Synthetic oligonucleotide
  Target: SOD1; (-) strand; PAM type: NRG; PAM sequence: GGG
gcgccactgcactccagcct

SEQ ID NO: 7612 - DNA, 20 bp, Artificial Sequence
  Description of Artificial Sequence: Synthetic oligonucleotide
  Target: SOD1; (-) strand; PAM type: NRG; PAM sequence: TGG
cgcgccactgcactccagcc

SEQ ID NO: 7613 - DNA, 20 bp, Artificial Sequence
  Description of Artificial Sequence: Synthetic oligonucleotide
  Target: SOD1; (-) strand; PAM type: NRG; PAM sequence: CAG
gagatcgcgccactgcactc

SEQ ID NO: 7614 - DNA, 20 bp, Artificial Sequence
  Description of Artificial Sequence: Synthetic oligonucleotide
  Target: SOD1; (-) strand; PAM type: NRG; PAM sequence: GAG
ggcggaggttgcagtgagct

SEQ ID NO: 7615 - DNA, 20 bp, Artificial Sequence
  Description of Artificial Sequence: Synthetic oligonucleotide
  Target: SOD1; (-) strand; PAM type: NRG; PAM sequence: GAG
tgggaggcggaggttgcagt

SEQ ID NO: 7616 - DNA, 20 bp, Artificial Sequence
  Description of Artificial Sequence: Synthetic oligonucleotide
  Target: SOD1; (-) strand; PAM type: NRG; PAM sequence: CAG
aacctgggaggcggaggttg

SEQ ID NO: 7617 - DNA, 20 bp, Artificial Sequence
  Description of Artificial Sequence: Synthetic oligonucleotide
  Target: SOD1; (-) strand; PAM type: NRG; PAM sequence: AGG
tgcttgaacctgggaggcgg

SEQ ID NO: 7618 - DNA, 20 bp, Artificial Sequence
  Description of Artificial Sequence: Synthetic oligonucleotide
  Target: SOD1; (-) strand; PAM type: NRG; PAM sequence: GAG
ttgcttgaacctgggaggcg

SEQ ID NO: 7619 - DNA, 20 bp, Artificial Sequence
  Description of Artificial Sequence: Synthetic oligonucleotide
  Target: SOD1; (-) strand; PAM type: NRG; PAM sequence: CGG
aattgcttgaacctgggagg

SEQ ID NO: 7620 - DNA, 20 bp, Artificial Sequence
  Description of Artificial Sequence: Synthetic oligonucleotide
  Target: SOD1; (-) strand; PAM type: NRG; PAM sequence: AGG
gagaattgcttgaacctggg

SEQ ID NO: 7621 - DNA, 20 bp, Artificial Sequence
  Description of Artificial Sequence: Synthetic oligonucleotide
  Target: SOD1; (-) strand; PAM type: NRG; PAM sequence: GAG
ggagaattgcttgaacctgg

SEQ ID NO: 7622 - DNA, 20 bp, Artificial Sequence
  Description of Artificial Sequence: Synthetic oligonucleotide
  Target: SOD1; (-) strand; PAM type: NRG; PAM sequence: GGG
caggagaattgcttgaacct

SEQ ID NO: 7623 - DNA, 20 bp, Artificial Sequence
  Description of Artificial Sequence: Synthetic oligonucleotide
  Target: SOD1; (-) strand; PAM type: NRG; PAM sequence: TGG
gcaggagaattgcttgaacc

SEQ ID NO: 7624 - DNA, 20 bp, Artificial Sequence
  Description of Artificial Sequence: Synthetic oligonucleotide
  Target: SOD1; (-) strand; PAM type: NRG; PAM sequence: GAG
tacccgggaggctgaggcag

SEQ ID NO: 7625 - DNA, 20 bp, Artificial Sequence
  Description of Artificial Sequence: Synthetic oligonucleotide
  Target: SOD1; (-) strand; PAM type: NRG; PAM sequence: AGG
gctacccgggaggctgaggc

SEQ ID NO: 7626 - DNA, 20 bp, Artificial Sequence
  Description of Artificial Sequence: Synthetic oligonucleotide
  Target: SOD1; (-) strand; PAM type: NRG; PAM sequence: CAG
agctacccgggaggctgagg

SEQ ID NO: 7627 - DNA, 20 bp, Artificial Sequence
  Description of Artificial Sequence: Synthetic oligonucleotide
  Target: SOD1; (-) strand; PAM type: NRG; PAM sequence: AGG
cccagctacccgggaggctg

SEQ ID NO: 7628 - DNA, 20 bp, Artificial Sequence
  Description of Artificial Sequence: Synthetic oligonucleotide
  Target: SOD1; (-) strand; PAM type: NRG; PAM sequence: GAG
tcccagctacccgggaggct

SEQ ID NO: 7629 - DNA, 20 bp, Artificial Sequence
  Description of Artificial Sequence: Synthetic oligonucleotide
  Target: SOD1; (-) strand; PAM type: NRG; PAM sequence: AGG
tgtagtcccagctacccggg

SEQ ID NO: 7630 - DNA, 20 bp, Artificial Sequence
  Description of Artificial Sequence: Synthetic oligonucleotide
  Target: SOD1; (-) strand; PAM type: NRG; PAM sequence: GAG
ctgtagtcccagctacccgg

SEQ ID NO: 7631 - DNA, 20 bp, Artificial Sequence
  Description of Artificial Sequence: Synthetic oligonucleotide
  Target: SOD1; (-) strand; PAM type: NRG; PAM sequence: GGG
gcctgtagtcccagctaccc

SEQ ID NO: 7632 - DNA, 20 bp, Artificial Sequence
  Description of Artificial Sequence: Synthetic oligonucleotide
  Target: SOD1; (-) strand; PAM type: NRG; PAM sequence: CGG
cgcctgtagtcccagctacc

SEQ ID NO: 7633 - DNA, 20 bp, Artificial Sequence
  Description of Artificial Sequence: Synthetic oligonucleotide
  Target: SOD1; (-) strand; PAM type: NRG; PAM sequence: CAG
gcggcgcgcgcctgtagtcc

SEQ ID NO: 7634 - DNA, 20 bp, Artificial Sequence
  Description of Artificial Sequence: Synthetic oligonucleotide
  Target: SOD1; (-) strand; PAM type: NRG; PAM sequence: TAG
ggcgtggcggcgcgcgcctg

SEQ ID NO: 7635 - DNA, 20 bp, Artificial Sequence
  Description of Artificial Sequence: Synthetic oligonucleotide
  Target: SOD1; (-) strand; PAM type: NRG; PAM sequence: CGG
aaaaaattagccaggcgtgg

SEQ ID NO: 7636 - DNA, 20 bp, Artificial Sequence
  Description of Artificial Sequence: Synthetic oligonucleotide
  Target: SOD1; (-) strand; PAM type: NRG; PAM sequence: TGG
tataaaaaattagccaggcg

SEQ ID NO: 7637 - DNA, 20 bp, Artificial Sequence
  Description of Artificial Sequence: Synthetic oligonucleotide
  Target: SOD1; (-) strand; PAM type: NRG; PAM sequence: AGG
taaaatataaaaaattagcc

SEQ ID NO: 7638 - DNA, 20 bp, Artificial Sequence
  Description of Artificial Sequence: Synthetic oligonucleotide
  Target: SOD1; (-) strand; PAM type: NRG; PAM sequence: CAG
ctaaaatataaaaaattagc

SEQ ID NO: 7639 - DNA, 20 bp, Artificial Sequence
  Description of Artificial Sequence: Synthetic oligonucleotide
  Target: SOD1; (-) strand; PAM type: NRG; PAM sequence: TAG
tctactaaaatataaaaaat

SEQ ID NO: 7640 - DNA, 20 bp, Artificial Sequence
  Description of Artificial Sequence: Synthetic oligonucleotide
  Target: SOD1; (-) strand; PAM type: NRG; PAM sequence: TGG
cgagaccatcctggccaaca

SEQ ID NO: 7641 - DNA, 20 bp, Artificial Sequence
  Description of Artificial Sequence: Synthetic oligonucleotide
  Target: SOD1; (-) strand; PAM type: NRG; PAM sequence: TGG
tcaacagatcgagaccatcc

SEQ ID NO: 7642 - DNA, 20 bp, Artificial Sequence
  Description of Artificial Sequence: Synthetic oligonucleotide
  Target: SOD1; (-) strand; PAM type: NRG; PAM sequence: GAG
gatcacgacgtcaacagatc

SEQ ID NO: 7643 - DNA, 20 bp, Artificial Sequence
  Description of Artificial Sequence: Synthetic oligonucleotide
  Target: SOD1; (-) strand; PAM type: NRG; PAM sequence: CAG
cgggtggatcacgacgtcaa

SEQ ID NO: 7644 - DNA, 20 bp, Artificial Sequence
  Description of Artificial Sequence: Synthetic oligonucleotide
  Target: SOD1; (-) strand; PAM type: NRG; PAM sequence: TGG
ctttgggaggccgaggcggg

SEQ ID NO: 7645 - DNA, 20 bp, Artificial Sequence
  Description of Artificial Sequence: Synthetic oligonucleotide
  Target: SOD1; (-) strand; PAM type: NRG; PAM sequence: GGG
gcactttgggaggccgaggc

SEQ ID NO: 7646 - DNA, 20 bp, Artificial Sequence
  Description of Artificial Sequence: Synthetic oligonucleotide
  Target: SOD1; (-) strand; PAM type: NRG; PAM sequence: CGG
agcactttgggaggccgagg

SEQ ID NO: 7647 - DNA, 20 bp, Artificial Sequence
  Description of Artificial Sequence: Synthetic oligonucleotide
  Target: SOD1; (-) strand; PAM type: NRG; PAM sequence: AGG
cccagcactttgggaggccg

SEQ ID NO: 7648 - DNA, 20 bp, Artificial Sequence
  Description of Artificial Sequence: Synthetic oligonucleotide
  Target: SOD1; (-) strand; PAM type: NRG; PAM sequence: GAG
tcccagcactttgggaggcc

SEQ ID NO: 7649 - DNA, 20 bp, Artificial Sequence
  Description of Artificial Sequence: Synthetic oligonucleotide
  Target: SOD1; (-) strand; PAM type: NRG; PAM sequence: AGG
tgtaatcccagcactttggg

SEQ ID NO: 7650 - DNA, 20 bp, Artificial Sequence
  Description of Artificial Sequence: Synthetic oligonucleotide
  Target: SOD1; (-) strand; PAM type: NRG; PAM sequence: GAG
ctgtaatcccagcactttgg

SEQ ID NO: 7651 - DNA, 20 bp, Artificial Sequence
  Description of Artificial Sequence: Synthetic oligonucleotide
  Target: SOD1; (-) strand; PAM type: NRG; PAM sequence: GGG
gcctgtaatcccagcacttt

SEQ ID NO: 7652 - DNA, 20 bp, Artificial Sequence
  Description of Artificial Sequence: Synthetic oligonucleotide
  Target: SOD1; (-) strand; PAM type: NRG; PAM sequence: TGG
cgcctgtaatcccagcactt

SEQ ID NO: 7653 - DNA, 20 bp, Artificial Sequence
  Description of Artificial Sequence: Synthetic oligonucleotide
  Target: SOD1; (-) strand; PAM type: NRG; PAM sequence: CAG
gtggctcacgcctgtaatcc

SEQ ID NO: 7654 - DNA, 20 bp, Artificial Sequence
  Description of Artificial Sequence: Synthetic oligonucleotide
  Target: SOD1; (-) strand; PAM type: NRG; PAM sequence: TGG
gcactggtggccgggcgggg

SEQ ID NO: 7655 - DNA, 20 bp, Artificial Sequence
  Description of Artificial Sequence: Synthetic oligonucleotide
  Target: SOD1; (-) strand; PAM type: NRG; PAM sequence: GGG
atagcactggtggccgggcg

SEQ ID NO: 7656 - DNA, 20 bp, Artificial Sequence
  Description of Artificial Sequence: Synthetic oligonucleotide
  Target: SOD1; (-) strand; PAM type: NRG; PAM sequence: GGG
aatagcactggtggccgggc

SEQ ID NO: 7657 - DNA, 20 bp, Artificial Sequence
  Description of Artificial Sequence: Synthetic oligonucleotide
  Target: SOD1; (-) strand; PAM type: NRG; PAM sequence: CGG
gaatagcactggtggccggg

SEQ ID NO: 7658 - DNA, 20 bp, Artificial Sequence
  Description of Artificial Sequence: Synthetic oligonucleotide
  Target: SOD1; (-) strand; PAM type: NRG; PAM sequence: GGG
taagaatagcactggtggcc

SEQ ID NO: 7659 - DNA, 20 bp, Artificial Sequence
  Description of Artificial Sequence: Synthetic oligonucleotide
  Target: SOD1; (-) strand; PAM type: NRG; PAM sequence: CGG
ttaagaatagcactggtggc

SEQ ID NO: 7660 - DNA, 20 bp, Artificial Sequence
  Description of Artificial Sequence: Synthetic oligonucleotide
  Target: SOD1; (-) strand; PAM type: NRG; PAM sequence: TGG
cgtcttaagaatagcactgg

SEQ ID NO: 7661 - DNA, 20 bp, Artificial Sequence
  Description of Artificial Sequence: Synthetic oligonucleotide
  Target: SOD1; (-) strand; PAM type: NRG; PAM sequence: TGG
aggcgtcttaagaatagcac

SEQ ID NO: 7662 - DNA, 20 bp, Artificial Sequence
  Description of Artificial Sequence: Synthetic oligonucleotide
  Target: SOD1; (-) strand; PAM type: NRG; PAM sequence: TAG
cctcagaggcgtcttaagaa

SEQ ID NO: 7663 - DNA, 20 bp, Artificial Sequence
  Description of Artificial Sequence: Synthetic oligonucleotide
  Target: SOD1; (-) strand; PAM type: NRG; PAM sequence: AAG
ggattcctcagaggcgtctt

SEQ ID NO: 7664 - DNA, 20 bp, Artificial Sequence
  Description of Artificial Sequence: Synthetic oligonucleotide
  Target: SOD1; (-) strand; PAM type: NRG; PAM sequence: AGG
agggagaagggattcctcag

SEQ ID NO: 7665 - DNA, 20 bp, Artificial Sequence
  Description of Artificial Sequence: Synthetic oligonucleotide
  Target: SOD1; (-) strand; PAM type: NRG; PAM sequence: GAG
cagggagaagggattcctca

SEQ ID NO: 7666 - DNA, 20 bp, Artificial Sequence
  Description of Artificial Sequence: Synthetic oligonucleotide
  Target: SOD1; (-) strand; PAM type: NRG; PAM sequence: CAG
gccagggagaagggattcct

SEQ ID NO: 7667 - DNA, 20 bp, Artificial Sequence
  Description of Artificial Sequence: Synthetic oligonucleotide
  Target: SOD1; (-) strand; PAM type: NRG; PAM sequence: GGG
ttctcaatggccagggagaa

SEQ ID NO: 7668 - DNA, 20 bp, Artificial Sequence
  Description of Artificial Sequence: Synthetic oligonucleotide
  Target: SOD1; (-) strand; PAM type: NRG; PAM sequence: AGG
attctcaatggccagggaga

SEQ ID NO: 7669 - DNA, 20 bp, Artificial Sequence
  Description of Artificial Sequence: Synthetic oligonucleotide
  Target: SOD1; (-) strand; PAM type: NRG; PAM sequence: AAG
gattctcaatggccagggag

SEQ ID NO: 7670 - DNA, 20 bp, Artificial Sequence
  Description of Artificial Sequence: Synthetic oligonucleotide
  Target: SOD1; (-) strand; PAM type: NRG; PAM sequence: GAG
atggattctcaatggccagg

SEQ ID NO: 7671 - DNA, 20 bp, Artificial Sequence
  Description of Artificial Sequence: Synthetic oligonucleotide
  Target: SOD1; (-) strand; PAM type: NRG; PAM sequence: GGG
gcatggattctcaatggcca

SEQ ID NO: 7672 - DNA, 20 bp, Artificial Sequence
  Description of Artificial Sequence: Synthetic oligonucleotide
  Target: SOD1; (-) strand; PAM type: NRG; PAM sequence: AGG
tgcatggattctcaatggcc

SEQ ID NO: 7673 - DNA, 20 bp, Artificial Sequence
  Description of Artificial Sequence: Synthetic oligonucleotide
  Target: SOD1; (-) strand; PAM type: NRG; PAM sequence: CAG
atgcatggattctcaatggc

SEQ ID NO: 7674 - DNA, 20 bp, Artificial Sequence
  Description of Artificial Sequence: Synthetic oligonucleotide
  Target: SOD1; (-) strand; PAM type: NRG; PAM sequence: TGG
gttcatgcatggattctcaa

SEQ ID NO: 7675 - DNA, 20 bp, Artificial Sequence
  Description of Artificial Sequence: Synthetic oligonucleotide
  Target: SOD1; (-) strand; PAM type: NRG; PAM sequence: TGG
ggaaaacctgggttcatgca

SEQ ID NO: 7676 - DNA, 20 bp, Artificial Sequence
  Description of Artificial Sequence: Synthetic oligonucleotide
  Target: SOD1; (-) strand; PAM type: NRG; PAM sequence: GGG
tcagggaaggtggaaaacct

SEQ ID NO: 7677 - DNA, 20 bp, Artificial Sequence
  Description of Artificial Sequence: Synthetic oligonucleotide
  Target: SOD1; (-) strand; PAM type: NRG; PAM sequence: TGG
ctcagggaaggtggaaaacc

SEQ ID NO: 7678 - DNA, 20 bp, Artificial Sequence
  Description of Artificial Sequence: Synthetic oligonucleotide
  Target: SOD1; (-) strand; PAM type: NRG; PAM sequence: TGG
tgcaagctgctcagggaagg

SEQ ID NO: 7679 - DNA, 20 bp, Artificial Sequence
  Description of Artificial Sequence: Synthetic oligonucleotide
  Target: SOD1; (-) strand; PAM type: NRG; PAM sequence: AGG
ctatgcaagctgctcaggga

SEQ ID NO: 7680 - DNA, 20 bp, Artificial Sequence
  Description of Artificial Sequence: Synthetic oligonucleotide
  Target: SOD1; (-) strand; PAM type: NRG; PAM sequence: AAG
actatgcaagctgctcaggg

SEQ ID NO: 7681 - DNA, 20 bp, Artificial Sequence
  Description of Artificial Sequence: Synthetic oligonucleotide
  Target: SOD1; (-) strand; PAM type: NRG; PAM sequence: GGG
ggaactatgcaagctgctca

SEQ ID NO: 7682 - DNA, 20 bp, Artificial Sequence
  Description of Artificial Sequence: Synthetic oligonucleotide
  Target: SOD1; (-) strand; PAM type: NRG; PAM sequence: AGG
aggaactatgcaagctgctc

SEQ ID NO: 7683 - DNA, 20 bp, Artificial Sequence
  Description of Artificial Sequence: Synthetic oligonucleotide
  Target: SOD1; (-) strand; PAM type: NRG; PAM sequence: CAG
aaggaactatgcaagctgct

SEQ ID NO: 7684 - DNA, 20 bp, Artificial Sequence
  Description of Artificial Sequence: Synthetic oligonucleotide
  Target: SOD1; (-) strand; PAM type: NRG; PAM sequence: AAG
cttaaaagaaggaactatgc

SEQ ID NO: 7685 - DNA, 20 bp, Artificial Sequence
  Description of Artificial Sequence: Synthetic oligonucleotide
  Target: SOD1; (-) strand; PAM type: NRG; PAM sequence: AGG
gaagtcaggcgcttaaaaga

SEQ ID NO: 7686 - DNA, 20 bp, Artificial Sequence
  Description of Artificial Sequence: Synthetic oligonucleotide
  Target: SOD1; (-) strand; PAM type: NRG; PAM sequence: AAG
cgaagtcaggcgcttaaaag

SEQ ID NO: 7687 - DNA, 20 bp, Artificial Sequence
  Description of Artificial Sequence: Synthetic oligonucleotide
  Target: SOD1; (-) strand; PAM type: NRG; PAM sequence: AAG
aaacgaagtcaggcgcttaa

SEQ ID NO: 7688 - DNA, 20 bp, Artificial Sequence
  Description of Artificial Sequence: Synthetic oligonucleotide
  Target: SOD1; (-) strand; PAM type: NRG; PAM sequence: AGG
gcaccaaacaaaacgaagtc

SEQ ID NO: 7689 - DNA, 20 bp, Artificial Sequence
  Description of Artificial Sequence: Synthetic oligonucleotide
  Target: SOD1; (-) strand; PAM type: NRG; PAM sequence: CAG
ggcaccaaacaaaacgaagt

SEQ ID NO: 7690 - DNA, 20 bp, Artificial Sequence
  Description of Artificial Sequence: Synthetic oligonucleotide
  Target: SOD1; (-) strand; PAM type: NRG; PAM sequence: AAG
aacgggcaccaaacaaaacg

SEQ ID NO: 7691 - DNA, 20 bp, Artificial Sequence
  Description of Artificial Sequence: Synthetic oligonucleotide
  Target: SOD1; (-) strand; PAM type: NRG; PAM sequence: GGG
ggctcattctcaggtacaac

SEQ ID NO: 7692 - DNA, 20 bp, Artificial Sequence
  Description of Artificial Sequence: Synthetic oligonucleotide
  Target: SOD1; (-) strand; PAM type: NRG; PAM sequence: CGG
aggctcattctcaggtacaa

SEQ ID NO: 7693 - DNA, 20 bp, Artificial Sequence
  Description of Artificial Sequence: Synthetic oligonucleotide
  Target: SOD1; (-) strand; PAM type: NRG; PAM sequence: AGG
actatccaaggctcattctc

SEQ ID NO: 7694 - DNA, 20 bp, Artificial Sequence
  Description of Artificial Sequence: Synthetic oligonucleotide
  Target: SOD1; (-) strand; PAM type: NRG; PAM sequence: CAG
cactatccaaggctcattct

SEQ ID NO: 7695 - DNA, 20 bp, Artificial Sequence
  Description of Artificial Sequence: Synthetic oligonucleotide
  Target: SOD1; (-) strand; PAM type: NRG; PAM sequence: AGG
ctggaatgctccactatcca

SEQ ID NO: 7696 - DNA, 20 bp, Artificial Sequence
  Description of Artificial Sequence: Synthetic oligonucleotide
  Target: SOD1; (-) strand; PAM type: NRG; PAM sequence: AAG
gctggaatgctccactatcc

SEQ ID NO: 7697 - DNA, 20 bp, Artificial Sequence
  Description of Artificial Sequence: Synthetic oligonucleotide
  Target: SOD1; (-) strand; PAM type: NRG; PAM sequence: TGG
tctctgcatatctggaaagc

SEQ ID NO: 7698 - DNA, 20 bp, Artificial Sequence
  Description of Artificial Sequence: Synthetic oligonucleotide
  Target: SOD1; (-) strand; PAM type: NRG; PAM sequence: AAG
attatctctgcatatctgga

SEQ ID NO: 7699 - DNA, 20 bp, Artificial Sequence
  Description of Artificial Sequence: Synthetic oligonucleotide
  Target: SOD1; (-) strand; PAM type: NRG; PAM sequence: TGG
atgtattatctctgcatatc

SEQ ID NO: 7700 - DNA, 20 bp, Artificial Sequence
  Description of Artificial Sequence: Synthetic oligonucleotide
  Target: SOD1; (-) strand; PAM type: NRG; PAM sequence: TAG
aggccaagccaagtagctga

SEQ ID NO: 7701 - DNA, 20 bp, Artificial Sequence
  Description of Artificial Sequence: Synthetic oligonucleotide
  Target: SOD1; (-) strand; PAM type: NRG; PAM sequence: TAG
acggaataggccaagccaag

SEQ ID NO: 7702 - DNA, 20 bp, Artificial Sequence
  Description of Artificial Sequence: Synthetic oligonucleotide
  Target: SOD1; (-) strand; PAM type: NRG; PAM sequence: AAG
aacacggaataggccaagcc

SEQ ID NO: 7703 - DNA, 20 bp, Artificial Sequence
  Description of Artificial Sequence: Synthetic oligonucleotide
  Target: SOD1; (-) strand; PAM type: NRG; PAM sequence: AAG
ttttaaacacggaataggcc

SEQ ID NO: 7704 - DNA, 20 bp, Artificial Sequence
  Description of Artificial Sequence: Synthetic oligonucleotide
  Target: SOD1; (-) strand; PAM type: NRG; PAM sequence: AGG
caagattttaaacacggaat

SEQ ID NO: 7705 - DNA, 20 bp, Artificial Sequence
  Description of Artificial Sequence: Synthetic oligonucleotide
  Target: SOD1; (-) strand; PAM type: NRG; PAM sequence: TAG
ccaagattttaaacacggaa

SEQ ID NO: 7706 - DNA, 20 bp, Artificial Sequence
  Description of Artificial Sequence: Synthetic oligonucleotide
  Target: SOD1; (-) strand; PAM type: NRG; PAM sequence: CGG
agagtccaagattttaaaca

SEQ ID NO: 7707 - DNA, 20 bp, Artificial Sequence
  Description of Artificial Sequence: Synthetic oligonucleotide
  Target: SOD1; (-) strand; PAM type: NRG; PAM sequence: AAG
taaaaactagcaaagagtcc

SEQ ID NO: 7708 - DNA, 20 bp, Artificial Sequence
  Description of Artificial Sequence: Synthetic oligonucleotide
  Target: SOD1; (-) strand; PAM type: NRG; PAM sequence: GAG
gatctgtaaaaactagcaaa

SEQ ID NO: 7709 - DNA, 20 bp, Artificial Sequence
  Description of Artificial Sequence: Synthetic oligonucleotide
  Target: SOD1; (-) strand; PAM type: NRG; PAM sequence: AAG
ctgatctgtaaaaactagca

SEQ ID NO: 7710 - DNA, 20 bp, Artificial Sequence
  Description of Artificial Sequence: Synthetic oligonucleotide
  Target: SOD1; (-) strand; PAM type: NRG; PAM sequence: TAG
aaattctgatctgtaaaaac

SEQ ID NO: 7711 - DNA, 20 bp, Artificial Sequence
  Description of Artificial Sequence: Synthetic oligonucleotide
  Target: SOD1; (-) strand; PAM type: NRG; PAM sequence: TGG
tcaagagaagctaggaaaac

SEQ ID NO: 7712 - DNA, 20 bp, Artificial Sequence
  Description of Artificial Sequence: Synthetic oligonucleotide
  Target: SOD1; (-) strand; PAM type: NRG; PAM sequence: AGG
aaaattcttcaagagaagct

SEQ ID NO: 7713 - DNA, 20 bp, Artificial Sequence
  Description of Artificial Sequence: Synthetic oligonucleotide
  Target: SOD1; (-) strand; PAM type: NRG; PAM sequence: TAG
aaaaattcttcaagagaagc

SEQ ID NO: 7714 - DNA, 20 bp, Artificial Sequence
  Description of Artificial Sequence: Synthetic oligonucleotide
  Target: SOD1; (-) strand; PAM type: NRG; PAM sequence: AAG
ctccaaaaattcttcaagag

SEQ ID NO: 7715 - DNA, 20 bp, Artificial Sequence
  Description of Artificial Sequence: Synthetic oligonucleotide
  Target: SOD1; (-) strand; PAM type: NRG; PAM sequence: GAG
gatctccaaaaattcttcaa

SEQ ID NO: 7716 - DNA, 20 bp, Artificial Sequence
  Description of Artificial Sequence: Synthetic oligonucleotide
  Target: SOD1; (-) strand; PAM type: NRG; PAM sequence: AAG
gagatctccaaaaattcttc

SEQ ID NO: 7717 - DNA, 20 bp, Artificial Sequence
  Description of Artificial Sequence: Synthetic oligonucleotide
  Target: SOD1; (-) strand; PAM type: NRG; PAM sequence: GAG
taatgaaggctcagtatgaa

SEQ ID NO: 7718 - DNA, 20 bp, Artificial Sequence
  Description of Artificial Sequence: Synthetic oligonucleotide
  Target: SOD1; (-) strand; PAM type: NRG; PAM sequence: AAG
gctaatgaaggctcagtatg

SEQ ID NO: 7719 - DNA, 20 bp, Artificial Sequence
  Description of Artificial Sequence: Synthetic oligonucleotide
  Target: SOD1; (-) strand; PAM type: NRG; PAM sequence: CAG
gtcctgggctaatgaaggct

SEQ ID NO: 7720 - DNA, 20 bp, Artificial Sequence
  Description of Artificial Sequence: Synthetic oligonucleotide
  Target: SOD1; (-) strand; PAM type: NRG; PAM sequence: AGG
gtactgtcctgggctaatga

SEQ ID NO: 7721 - DNA, 20 bp, Artificial Sequence
  Description of Artificial Sequence: Synthetic oligonucleotide
  Target: SOD1; (-) strand; PAM type: NRG; PAM sequence: AAG
agtactgtcctgggctaatg

SEQ ID NO: 7722 - DNA, 20 bp, Artificial Sequence
  Description of Artificial Sequence: Synthetic oligonucleotide
  Target: SOD1; (-) strand; PAM type: NRG; PAM sequence: GGG
tgctacagcagtactgtcct

SEQ ID NO: 7723 - DNA, 20 bp, Artificial Sequence
  Description of Artificial Sequence: Synthetic oligonucleotide
  Target: SOD1; (-) strand; PAM type: NRG; PAM sequence: TGG
ctgctacagcagtactgtcc

SEQ ID NO: 7724 - DNA, 20 bp, Artificial Sequence
  Description of Artificial Sequence: Synthetic oligonucleotide
  Target: SOD1; (-) strand; PAM type: NRG; PAM sequence: CAG
aaatatatgaactgctacag

SEQ ID NO: 7725 - DNA, 20 bp, Artificial Sequence
  Description of Artificial Sequence: Synthetic oligonucleotide
  Target: SOD1; (-) strand; PAM type: NRG; PAM sequence: CAG
aaaaaatatatgaactgcta

SEQ ID NO: 7726 - DNA, 20 bp, Artificial Sequence
  Description of Artificial Sequence: Synthetic oligonucleotide
  Target: SOD1; (-) strand; PAM type: NRG; PAM sequence: AAG
gtgaataacacaggcctggg

SEQ ID NO: 7727 - DNA, 20 bp, Artificial Sequence
  Description of Artificial Sequence: Synthetic oligonucleotide
  Target: SOD1; (-) strand; PAM type: NRG; PAM sequence: GGG
taagtgaataacacaggcct

SEQ ID NO: 7728 - DNA, 20 bp, Artificial Sequence
  Description of Artificial Sequence: Synthetic oligonucleotide
  Target: SOD1; (-) strand; PAM type: NRG; PAM sequence: TGG
ttaagtgaataacacaggcc

SEQ ID NO: 7729 - DNA, 20 bp, Artificial Sequence
  Description of Artificial Sequence: Synthetic oligonucleotide
  Target: SOD1; (-) strand; PAM type: NRG; PAM sequence: AGG
tgaacttaagtgaataacac

SEQ ID NO: 7730 - DNA, 20 bp, Artificial Sequence
  Description of Artificial Sequence: Synthetic oligonucleotide
  Target: SOD1; (-) strand; PAM type: NRG; PAM sequence: CAG
atgaacttaagtgaataaca

SEQ ID NO: 7731 - DNA, 20 bp, Artificial Sequence
  Description of Artificial Sequence: Synthetic oligonucleotide
  Target: SOD1; (-) strand; PAM type: NRG; PAM sequence: AAG
agggaccaggctatgaactt

SEQ ID NO: 7732 - DNA, 20 bp, Artificial Sequence
  Description of Artificial Sequence: Synthetic oligonucleotide
  Target: SOD1; (-) strand; PAM type: NRG; PAM sequence: AGG
ggtacaaccctgcagggacc

SEQ ID NO: 7733 - DNA, 20 bp, Artificial Sequence
  Description of Artificial Sequence: Synthetic oligonucleotide
  Target: SOD1; (-) strand; PAM type: NRG; PAM sequence: CAG
gggtacaaccctgcagggac

SEQ ID NO: 7734 - DNA, 20 bp, Artificial Sequence
  Description of Artificial Sequence: Synthetic oligonucleotide
  Target: SOD1; (-) strand; PAM type: NRG; PAM sequence: GGG
tgctcgggtacaaccctgca

SEQ ID NO: 7735 - DNA, 20 bp, Artificial Sequence
  Description of Artificial Sequence: Synthetic oligonucleotide
  Target: SOD1; (-) strand; PAM type: NRG; PAM sequence: AGG
gtgctcgggtacaaccctgc

SEQ ID NO: 7736 - DNA, 20 bp, Artificial Sequence
  Description of Artificial Sequence: Synthetic oligonucleotide
  Target: SOD1; (-) strand; PAM type: NRG; PAM sequence: CAG
tgtgctcgggtacaaccctg

SEQ ID NO: 7737 - DNA, 20 bp, Artificial Sequence
  Description of Artificial Sequence: Synthetic oligonucleotide
  Target: SOD1; (-) strand; PAM type: NRG; PAM sequence: GGG
acatctaagtagctgtgctc

SEQ ID NO: 7738 - DNA, 20 bp, Artificial Sequence
  Description of Artificial Sequence: Synthetic oligonucleotide
  Target: SOD1; (-) strand; PAM type: NRG; PAM sequence: CGG
gacatctaagtagctgtgct

SEQ ID NO: 7739 - DNA, 20 bp, Artificial Sequence
  Description of Artificial Sequence: Synthetic oligonucleotide
  Target: SOD1; (-) strand; PAM type: NRG; PAM sequence: TAG
atacattcaggacatctaag

SEQ ID NO: 7740 - DNA, 20 bp, Artificial Sequence
  Description of Artificial Sequence: Synthetic oligonucleotide
  Target: SOD1; (-) strand; PAM type: NRG; PAM sequence: AAG
gtaatacattcaggacatct

SEQ ID NO: 7741 - DNA, 20 bp, Artificial Sequence
  Description of Artificial Sequence: Synthetic oligonucleotide
  Target: SOD1; (-) strand; PAM type: NRG; PAM sequence: AGG
atttaaccggtaatacattc

SEQ ID NO: 7742 - DNA, 20 bp, Artificial Sequence
  Description of Artificial Sequence: Synthetic oligonucleotide
  Target: SOD1; (-) strand; PAM type: NRG; PAM sequence: CAG
catttaaccggtaatacatt

SEQ ID NO: 7743 - DNA, 20 bp, Artificial Sequence
  Description of Artificial Sequence: Synthetic oligonucleotide
  Target: SOD1; (-) strand; PAM type: NRG; PAM sequence: CGG
ctttgaaacctccatttaac

SEQ ID NO: 7744 - DNA, 20 bp, Artificial Sequence
  Description of Artificial Sequence: Synthetic oligonucleotide
  Target: SOD1; (-) strand; PAM type: NRG; PAM sequence: AGG
agcacagggccaaaaacagc

SEQ ID NO: 7745 - DNA, 20 bp, Artificial Sequence
  Description of Artificial Sequence: Synthetic oligonucleotide
  Target: SOD1; (-) strand; PAM type: NRG; PAM sequence: CAG
gagcacagggccaaaaacag

SEQ ID NO: 7746 - DNA, 20 bp, Artificial Sequence
  Description of Artificial Sequence: Synthetic oligonucleotide
  Target: SOD1; (-) strand; PAM type: NRG; PAM sequence: CAG
caagagcacagggccaaaaa

SEQ ID NO: 7747 - DNA, 20 bp, Artificial Sequence
  Description of Artificial Sequence: Synthetic oligonucleotide
  Target: SOD1; (-) strand; PAM type: NRG; PAM sequence: GGG
actctgttatcaagagcaca

SEQ ID NO: 7748 - DNA, 20 bp, Artificial Sequence
  Description of Artificial Sequence: Synthetic oligonucleotide
  Target: SOD1; (-) strand; PAM type: NRG; PAM sequence: AGG
cactctgttatcaagagcac

SEQ ID NO: 7749 - DNA, 20 bp, Artificial Sequence
  Description of Artificial Sequence: Synthetic oligonucleotide
  Target: SOD1; (-) strand; PAM type: NRG; PAM sequence: CAG
acactctgttatcaagagca

SEQ ID NO: 7750 - DNA, 20 bp, Artificial Sequence
  Description of Artificial Sequence: Synthetic oligonucleotide
  Target: SOD1; (-) strand; PAM type: NRG; PAM sequence: GAG
ctcaaacactctgttatcaa

SEQ ID NO: 7751 - DNA, 20 bp, Artificial Sequence
  Description of Artificial Sequence: Synthetic oligonucleotide
  Target: SOD1; (-) strand; PAM type: NRG; PAM sequence: AAG
ccctcaaacactctgttatc

SEQ ID NO: 7752 - DNA, 20 bp, Artificial Sequence
  Description of Artificial Sequence: Synthetic oligonucleotide
  Target: SOD1; (-) strand; PAM type: NRG; PAM sequence: AAG
ttggaaaaactcaaatgtga

SEQ ID NO: 7753 - DNA, 20 bp, Artificial Sequence
  Description of Artificial Sequence: Synthetic oligonucleotide
  Target: SOD1; (-) strand; PAM type: NRG; PAM sequence: TGG
tcttctacaacctttaattt

SEQ ID NO: 7754 - DNA, 20 bp, Artificial Sequence
  Description of Artificial Sequence: Synthetic oligonucleotide
  Target: SOD1; (-) strand; PAM type: NRG; PAM sequence: TAG
aattcttttctttttgacaa

SEQ ID NO: 7755 - DNA, 20 bp, Artificial Sequence
  Description of Artificial Sequence: Synthetic oligonucleotide
  Target: SOD1; (-) strand; PAM type: NRG; PAM sequence: TGG
attgctcaaatgaagtatcc

SEQ ID NO: 7756 - DNA, 20 bp, Artificial Sequence
  Description of Artificial Sequence: Synthetic oligonucleotide
  Target: SOD1; (-) strand; PAM type: NRG; PAM sequence: AAG
aaaatatcattgctcaaatg

SEQ ID NO: 7757 - DNA, 20 bp, Artificial Sequence
  Description of Artificial Sequence: Synthetic oligonucleotide
  Target: SOD1; (-) strand; PAM type: NRG; PAM sequence: TGG
cttaagatgtgactttccac

SEQ ID NO: 7758 - DNA, 20 bp, Artificial Sequence
  Description of Artificial Sequence: Synthetic oligonucleotide
  Target: SOD1; (-) strand; PAM type: NRG; PAM sequence: AAG
gttaaggggcattaaccctt

SEQ ID NO: 7759 - DNA, 20 bp, Artificial Sequence
  Description of Artificial Sequence: Synthetic oligonucleotide
  Target: SOD1; (-) strand; PAM type: NRG; PAM sequence: GGG
aaatacggccaacagttaag

SEQ ID NO: 7760 - DNA, 20 bp, Artificial Sequence
  Description of Artificial Sequence: Synthetic oligonucleotide
  Target: SOD1; (-) strand; PAM type: NRG; PAM sequence: GGG
caaatacggccaacagttaa

SEQ ID NO: 7761 - DNA, 20 bp, Artificial Sequence
  Description of Artificial Sequence: Synthetic oligonucleotide
  Target: SOD1; (-) strand; PAM type: NRG; PAM sequence: AGG
tcaaatacggccaacagtta

SEQ ID NO: 7762 - DNA, 20 bp, Artificial Sequence
  Description of Artificial Sequence: Synthetic oligonucleotide
  Target: SOD1; (-) strand; PAM type: NRG; PAM sequence: AAG
ttcaaatacggccaacagtt

SEQ ID NO: 7763 - DNA, 20 bp, Artificial Sequence
  Description of Artificial Sequence: Synthetic oligonucleotide
  Target: SOD1; (-) strand; PAM type: NRG; PAM sequence: CAG
ttgttttcaaatacggccaa

SEQ ID NO: 7764 - DNA, 20 bp, Artificial Sequence
  Description of Artificial Sequence: Synthetic oligonucleotide
  Target: SOD1; (-) strand; PAM type: NRG; PAM sequence: CGG
gcttggtttgttttcaaata

SEQ ID NO: 7765 - DNA, 20 bp, Artificial Sequence
  Description of Artificial Sequence: Synthetic oligonucleotide
  Target: SOD1; (-) strand; PAM type: NRG; PAM sequence: TGG
agtgtctcttgtttttagct

SEQ ID NO: 7766 - DNA, 20 bp, Artificial Sequence
  Description of Artificial Sequence: Synthetic oligonucleotide
  Target: SOD1; (-) strand; PAM type: NRG; PAM sequence: TAG
atgtcagtgtctcttgtttt

SEQ ID NO: 7767 - DNA, 20 bp, Artificial Sequence
  Description of Artificial Sequence: Synthetic oligonucleotide
  Target: SOD1; (-) strand; PAM type: NRG; PAM sequence: CAG
cacaccgtcatacaacatgt

SEQ ID NO: 7768 - DNA, 20 bp, Artificial Sequence
  Description of Artificial Sequence: Synthetic oligonucleotide
  Target: SOD1; (-) strand; PAM type: NRG; PAM sequence: AGG
ggaagttacaactagatctc

SEQ ID NO: 7769 - DNA, 20 bp, Artificial Sequence
  Description of Artificial Sequence: Synthetic oligonucleotide
  Target: SOD1; (-) strand; PAM type: NRG; PAM sequence: CAG
aggaagttacaactagatct

SEQ ID NO: 7770 - DNA, 20 bp, Artificial Sequence
  Description of Artificial Sequence: Synthetic oligonucleotide
  Target: SOD1; (-) strand; PAM type: NRG; PAM sequence: TAG
gaaatcaaggaagttacaac

SEQ ID NO: 7771 - DNA, 20 bp, Artificial Sequence
  Description of Artificial Sequence: Synthetic oligonucleotide
  Target: SOD1; (-) strand; PAM type: NRG; PAM sequence: AAG
gctacatacagaaatcaagg

SEQ ID NO: 7772 - DNA, 20 bp, Artificial Sequence
  Description of Artificial Sequence: Synthetic oligonucleotide
  Target: SOD1; (-) strand; PAM type: NRG; PAM sequence: AGG
gtggctacatacagaaatca

SEQ ID NO: 7773 - DNA, 20 bp, Artificial Sequence
  Description of Artificial Sequence: Synthetic oligonucleotide
  Target: SOD1; (-) strand; PAM type: NRG; PAM sequence: AAG
cgtggctacatacagaaatc

SEQ ID NO: 7774 - DNA, 20 bp, Artificial Sequence
  Description of Artificial Sequence: Synthetic oligonucleotide
  Target: SOD1; (-) strand; PAM type: NRG; PAM sequence: CAG
tggtgctccgtggctacata

SEQ ID NO: 7775 - DNA, 20 bp, Artificial Sequence
  Description of Artificial Sequence: Synthetic oligonucleotide
  Target: SOD1; (-) strand; PAM type: NRG; PAM sequence: TGG
tgacaggtaatggtgctccg

SEQ ID NO: 7776 - DNA, 20 bp, Artificial Sequence
  Description of Artificial Sequence: Synthetic oligonucleotide
  Target: SOD1; (-) strand; PAM type: NRG; PAM sequence: TGG
caggtaatggtgacaggtaa

SEQ ID NO: 7777 - DNA, 20 bp, Artificial Sequence
  Description of Artificial Sequence: Synthetic oligonucleotide
  Target: SOD1; (-) strand; PAM type: NRG; PAM sequence: AGG
gccattcaggtaatggtgac

SEQ ID NO: 7778 - DNA, 20 bp, Artificial Sequence
  Description of Artificial Sequence: Synthetic oligonucleotide
  Target: SOD1; (-) strand; PAM type: NRG; PAM sequence: CAG
agccattcaggtaatggtga

SEQ ID NO: 7779 - DNA, 20 bp, Artificial Sequence
  Description of Artificial Sequence: Synthetic oligonucleotide
  Target: SOD1; (-) strand; PAM type: NRG; PAM sequence: TGG
cagtatagccattcaggtaa

SEQ ID NO: 7780 - DNA, 20 bp, Artificial Sequence
  Description of Artificial Sequence: Synthetic oligonucleotide
  Target: SOD1; (-) strand; PAM type: NRG; PAM sequence: AGG
agcaagcagtatagccattc

SEQ ID NO: 7781 - DNA, 20 bp, Artificial Sequence
  Description of Artificial Sequence: Synthetic oligonucleotide
  Target: SOD1; (-) strand; PAM type: NRG; PAM sequence: CAG
aagcaagcagtatagccatt

SEQ ID NO: 7782 - DNA, 20 bp, Artificial Sequence
  Description of Artificial Sequence: Synthetic oligonucleotide
  Target: SOD1; (-) strand; PAM type: NRG; PAM sequence: TAG
caaaatgaaagcaagcagta

SEQ ID NO: 7783 - DNA, 20 bp, Artificial Sequence
  Description of Artificial Sequence: Synthetic oligonucleotide
  Target: SOD1; (-) strand; PAM type: NRG; PAM sequence: CAG
tctaccaaaatgaaagcaag

SEQ ID NO: 7784 - DNA, 20 bp, Artificial Sequence
  Description of Artificial Sequence: Synthetic oligonucleotide
  Target: SOD1; (-) strand; PAM type: NRG; PAM sequence: AAG
cactctaccaaaatgaaagc

SEQ ID NO: 7785 - DNA, 20 bp, Artificial Sequence
  Description of Artificial Sequence: Synthetic oligonucleotide
  Target: SOD1; (-) strand; PAM type: NRG; PAM sequence: AAG
tttccactctaccaaaatga

SEQ ID NO: 7786 - DNA, 20 bp, Artificial Sequence
  Description of Artificial Sequence: Synthetic oligonucleotide
  Target: SOD1; (-) strand; PAM type: NRG; PAM sequence: AGG
cttttcaagcactgaaacct

SEQ ID NO: 7787 - DNA, 20 bp, Artificial Sequence
  Description of Artificial Sequence: Synthetic oligonucleotide
  Target: SOD1; (-) strand; PAM type: NRG; PAM sequence: TAG
tcttttcaagcactgaaacc

SEQ ID NO: 7788 - DNA, 20 bp, Artificial Sequence
  Description of Artificial Sequence: Synthetic oligonucleotide
  Target: SOD1; (-) strand; PAM type: NRG; PAM sequence: AAG
ctgctttctgaaatcttttc

SEQ ID NO: 7789 - DNA, 20 bp, Artificial Sequence
  Description of Artificial Sequence: Synthetic oligonucleotide
  Target: SOD1; (-) strand; PAM type: NRG; PAM sequence: CAG
aggactgattctagtctaac

SEQ ID NO: 7790 - DNA, 20 bp, Artificial Sequence
  Description of Artificial Sequence: Synthetic oligonucleotide
  Target: SOD1; (-) strand; PAM type: NRG; PAM sequence: TAG
ccccaggagaggactgattc

SEQ ID NO: 7791 - DNA, 20 bp, Artificial Sequence
  Description of Artificial Sequence: Synthetic oligonucleotide
  Target: SOD1; (-) strand; PAM type: NRG; PAM sequence: AGG
tattccactgcccccaggag

SEQ ID NO: 7792 - DNA, 20 bp, Artificial Sequence
  Description of Artificial Sequence: Synthetic oligonucleotide
  Target: SOD1; (-) strand; PAM type: NRG; PAM sequence: GAG
atattccactgcccccagga

SEQ ID NO: 7793 - DNA, 20 bp, Artificial Sequence
  Description of Artificial Sequence: Synthetic oligonucleotide
  Target: SOD1; (-) strand; PAM type: NRG; PAM sequence: GAG
ttatattccactgcccccag

SEQ ID NO: 7794 - DNA, 20 bp, Artificial Sequence
  Description of Artificial Sequence: Synthetic oligonucleotide
  Target: SOD1; (-) strand; PAM type: NRG; PAM sequence: AGG
tattatattccactgccccc

SEQ ID NO: 7795 - DNA, 20 bp, Artificial Sequence
  Description of Artificial Sequence: Synthetic oligonucleotide
  Target: SOD1; (-) strand; PAM type: NRG; PAM sequence: CAG
atattatattccactgcccc

SEQ ID NO: 7796 - DNA, 20 bp, Artificial Sequence
  Description of Artificial Sequence: Synthetic oligonucleotide
  Target: SOD1; (-) strand; PAM type: NRG; PAM sequence: CAG
aggtatttttaattagcagt

SEQ ID NO: 7797 - DNA, 20 bp, Artificial Sequence
  Description of Artificial Sequence: Synthetic oligonucleotide
  Target: SOD1; (-) strand; PAM type: NRG; PAM sequence: CAG
tcacaggtatttttaattag

SEQ ID NO: 7798 - DNA, 20 bp, Artificial Sequence
  Description of Artificial Sequence: Synthetic oligonucleotide
  Target: SOD1; (-) strand; PAM type: NRG; PAM sequence: TAG
ctatcacaggtatttttaat

SEQ ID NO: 7799 - DNA, 20 bp, Artificial Sequence
  Description of Artificial Sequence: Synthetic oligonucleotide
  Target: SOD1; (-) strand; PAM type: NRG; PAM sequence: AGG
ccaccacgcccggctatcac

SEQ ID NO: 7800 - DNA, 20 bp, Artificial Sequence
  Description of Artificial Sequence: Synthetic oligonucleotide
  Target: SOD1; (-) strand; PAM type: NRG; PAM sequence: CAG
gccaccacgcccggctatca

SEQ ID NO: 7801 - DNA, 20 bp, Artificial Sequence
  Description of Artificial Sequence: Synthetic oligonucleotide
  Target: SOD1; (-) strand; PAM type: NRG; PAM sequence: CGG
caggcgtaagccaccacgcc

SEQ ID NO: 7802 - DNA, 20 bp, Artificial Sequence
  Description of Artificial Sequence: Synthetic oligonucleotide
  Target: SOD1; (-) strand; PAM type: NRG; PAM sequence: AAG
agtgctgggattacaggcgt

SEQ ID NO: 7803 - DNA, 20 bp, Artificial Sequence
  Description of Artificial Sequence: Synthetic oligonucleotide
  Target: SOD1; (-) strand; PAM type: NRG; PAM sequence: AGG
tcccaaagtgctgggattac

SEQ ID NO: 7804 - DNA, 20 bp, Artificial Sequence
  Description of Artificial Sequence: Synthetic oligonucleotide
  Target: SOD1; (-) strand; PAM type: NRG; PAM sequence: CAG
ctcccaaagtgctgggatta

SEQ ID NO: 7805 - DNA, 20 bp, Artificial Sequence
  Description of Artificial Sequence: Synthetic oligonucleotide
  Target: SOD1; (-) strand; PAM type: NRG; PAM sequence: GGG
tctcggcctcccaaagtgct

SEQ ID NO: 7806 - DNA, 20 bp, Artificial Sequence
  Description of Artificial Sequence: Synthetic oligonucleotide
  Target: SOD1; (-) strand; PAM type: NRG; PAM sequence: TGG
gtctcggcctcccaaagtgc

SEQ ID NO: 7807 - DNA, 20 bp, Artificial Sequence
  Description of Artificial Sequence: Synthetic oligonucleotide
  Target: SOD1; (-) strand; PAM type: NRG; PAM sequence: AAG
ccacccgtctcggcctccca

SEQ ID NO: 7808 - DNA, 20 bp, Artificial Sequence
  Description of Artificial Sequence: Synthetic oligonucleotide
  Target: SOD1; (-) strand; PAM type: NRG; PAM sequence: CGG
acctcgtgatccacccgtct

SEQ ID NO: 7809 - DNA, 20 bp, Artificial Sequence
  Description of Artificial Sequence: Synthetic oligonucleotide
  Target: SOD1; (-) strand; PAM type: NRG; PAM sequence: TGG
tttcaccgtgttagccagga

SEQ ID NO: 7810 - DNA, 20 bp, Artificial Sequence
  Description of Artificial Sequence: Synthetic oligonucleotide
  Target: SOD1; (-) strand; PAM type: NRG; PAM sequence: AGG
ggggtttcaccgtgttagcc

SEQ ID NO: 7811 - DNA, 20 bp, Artificial Sequence
  Description of Artificial Sequence: Synthetic oligonucleotide
  Target: SOD1; (-) strand; PAM type: NRG; PAM sequence: CAG
cggggtttcaccgtgttagc

SEQ ID NO: 7812 - DNA, 20 bp, Artificial Sequence
  Description of Artificial Sequence: Synthetic oligonucleotide
  Target: SOD1; (-) strand; PAM type: NRG; PAM sequence: TAG
gagacggggtttcaccgtgt

SEQ ID NO: 7813 - DNA, 20 bp, Artificial Sequence
  Description of Artificial Sequence: Synthetic oligonucleotide
  Target: SOD1; (-) strand; PAM type: NRG; PAM sequence: GGG
ttgcatttttagtagagacg

SEQ ID NO: 7814 - DNA, 20 bp, Artificial Sequence
  Description of Artificial Sequence: Synthetic oligonucleotide
  Target: SOD1; (-) strand; PAM type: NRG; PAM sequence: GGG
tttgcatttttagtagagac

SEQ ID NO: 7815 - DNA, 20 bp, Artificial Sequence
  Description of Artificial Sequence: Synthetic oligonucleotide
  Target: SOD1; (-) strand; PAM type: NRG; PAM sequence: CGG
ttttgcatttttagtagaga

SEQ ID NO: 7816 - DNA, 20 bp, Artificial Sequence
  Description of Artificial Sequence: Synthetic oligonucleotide
  Target: SOD1; (-) strand; PAM type: NRG; PAM sequence: GAG
atttttttgcatttttagta

SEQ ID NO: 7817 - DNA, 20 bp, Artificial Sequence
  Description of Artificial Sequence: Synthetic oligonucleotide
  Target: SOD1; (-) strand; PAM type: NRG; PAM sequence: TAG
taatttttttgcatttttag

SEQ ID NO: 7818 - DNA, 20 bp, Artificial Sequence
  Description of Artificial Sequence: Synthetic oligonucleotide
  Target: SOD1; (-) strand; PAM type: NRG; PAM sequence: TAG
ggctaatttttttgcatttt

SEQ ID NO: 7819 - DNA, 20 bp, Artificial Sequence
  Description of Artificial Sequence: Synthetic oligonucleotide
  Target: SOD1; (-) strand; PAM type: NRG; PAM sequence: CGG
caggcgcccaccaccacacc

SEQ ID NO: 7820 - DNA, 20 bp, Artificial Sequence
  Description of Artificial Sequence: Synthetic oligonucleotide
  Target: SOD1; (-) strand; PAM type: NRG; PAM sequence: AGG
tcctgagtagctgggactac

SEQ ID NO: 7821 - DNA, 20 bp, Artificial Sequence
  Description of Artificial Sequence: Synthetic oligonucleotide
  Target: SOD1; (-) strand; PAM type: NRG; PAM sequence: CAG
ctcctgagtagctgggacta

SEQ ID NO: 7822 - DNA, 20 bp, Artificial Sequence
  Description of Artificial Sequence: Synthetic oligonucleotide
  Target: SOD1; (-) strand; PAM type: NRG; PAM sequence: GGG
cctcagcctcctgagtagct

SEQ ID NO: 7823 - DNA, 20 bp, Artificial Sequence
  Description of Artificial Sequence: Synthetic oligonucleotide
  Target: SOD1; (-) strand; PAM type: NRG; PAM sequence: TGG
gcctcagcctcctgagtagc

SEQ ID NO: 7824 - DNA, 20 bp, Artificial Sequence
  Description of Artificial Sequence: Synthetic oligonucleotide
  Target: SOD1; (-) strand; PAM type: NRG; PAM sequence: TAG
tcctgcctcagcctcctgag

SEQ ID NO: 7825 - DNA, 20 bp, Artificial Sequence
  Description of Artificial Sequence: Synthetic oligonucleotide
  Target: SOD1; (-) strand; PAM type: NRG; PAM sequence: GAG
ttctcctgcctcagcctcct

SEQ ID NO: 7826 - DNA, 20 bp, Artificial Sequence
  Description of Artificial Sequence: Synthetic oligonucleotide
  Target: SOD1; (-) strand; PAM type: NRG; PAM sequence: CAG
ttcatgccattctcctgcct

SEQ ID NO: 7827 - DNA, 20 bp, Artificial Sequence
  Description of Artificial Sequence: Synthetic oligonucleotide
  Target: SOD1; (-) strand; PAM type: NRG; PAM sequence: AGG
cactgcaagctccgcctccc

SEQ ID NO: 7828 - DNA, 20 bp, Artificial Sequence
  Description of Artificial Sequence: Synthetic oligonucleotide
  Target: SOD1; (-) strand; PAM type: NRG; PAM sequence: CAG
tcactgcaagctccgcctcc

SEQ ID NO: 7829 - DNA, 20 bp, Artificial Sequence
  Description of Artificial Sequence: Synthetic oligonucleotide
  Target: SOD1; (-) strand; PAM type: NRG; PAM sequence: AAG
acatgatctcggctcactgc

SEQ ID NO: 7830 - DNA, 20 bp, Artificial Sequence
  Description of Artificial Sequence: Synthetic oligonucleotide
  Target: SOD1; (-) strand; PAM type: NRG; PAM sequence: CGG
ggagtgcagtgacatgatct

SEQ ID NO: 7831 - DNA, 20 bp, Artificial Sequence
  Description of Artificial Sequence: Synthetic oligonucleotide
  Target: SOD1; (-) strand; PAM type: NRG; PAM sequence: CAG
ctgtcgcccaggctggagtg

SEQ ID NO: 7832 - DNA, 20 bp, Artificial Sequence
  Description of Artificial Sequence: Synthetic oligonucleotide
  Target: SOD1; (-) strand; PAM type: NRG; PAM sequence: GAG
tcgctctgtcgcccaggctg

SEQ ID NO: 7833 - DNA, 20 bp, Artificial Sequence
  Description of Artificial Sequence: Synthetic oligonucleotide
  Target: SOD1; (-) strand; PAM type: NRG; PAM sequence: TGG
tctcgctctgtcgcccaggc

SEQ ID NO: 7834 - DNA, 20 bp, Artificial Sequence
  Description of Artificial Sequence: Synthetic oligonucleotide
  Target: SOD1; (-) strand; PAM type: NRG; PAM sequence: AGG
cgagtctcgctctgtcgccc

SEQ ID NO: 7835 - DNA, 20 bp, Artificial Sequence
  Description of Artificial Sequence: Synthetic oligonucleotide
  Target: SOD1; (-) strand; PAM type: NRG; PAM sequence: CAG
acgagtctcgctctgtcgcc

SEQ ID NO: 7836 - DNA, 20 bp, Artificial Sequence
  Description of Artificial Sequence: Synthetic oligonucleotide
  Target: SOD1; (-) strand; PAM type: NRG; PAM sequence: GAG
tttctttttttttttgagac

SEQ ID NO: 7837 - DNA, 20 bp, Artificial Sequence
  Description of Artificial Sequence: Synthetic oligonucleotide
  Target: SOD1; (-) strand; PAM type: NRG; PAM sequence: GAG
gtttttttcttttttttttt

SEQ ID NO: 7838 - DNA, 20 bp, Artificial Sequence
  Description of Artificial Sequence: Synthetic oligonucleotide
  Target: SOD1; (-) strand; PAM type: NRG; PAM sequence: AAG
tgtttttaagtgtccatcat

SEQ ID NO: 7839 - DNA, 20 bp, Artificial Sequence
  Description of Artificial Sequence: Synthetic oligonucleotide
  Target: SOD1; (-) strand; PAM type: NRG; PAM sequence: AAG
cccactcagtgagtgttttt

SEQ ID NO: 7840 - DNA, 20 bp, Artificial Sequence
  Description of Artificial Sequence: Synthetic oligonucleotide
  Target: SOD1; (-) strand; PAM type: NRG; PAM sequence: GAG
ctctccactccccactcagt

SEQ ID NO: 7841 - DNA, 20 bp, Artificial Sequence
  Description of Artificial Sequence: Synthetic oligonucleotide
  Target: SOD1; (-) strand; PAM type: NRG; PAM sequence: CAG
cctgctctccactccccact

SEQ ID NO: 7842 - DNA, 20 bp, Artificial Sequence
  Description of Artificial Sequence: Synthetic oligonucleotide
  Target: SOD1; (-) strand; PAM type: NRG; PAM sequence: GGG
aatgtccaacaggctaccct

SEQ ID NO: 7843 - DNA, 20 bp, Artificial Sequence
  Description of Artificial Sequence: Synthetic oligonucleotide
  Target: SOD1; (-) strand; PAM type: NRG; PAM sequence: TGG
aaatgtccaacaggctaccc

SEQ ID NO: 7844 - DNA, 20 bp, Artificial Sequence
  Description of Artificial Sequence: Synthetic oligonucleotide
  Target: SOD1; (-) strand; PAM type: NRG; PAM sequence: AGG
tcgccctggaaatgtccaac

SEQ ID NO: 7845 - DNA, 20 bp, Artificial Sequence
  Description of Artificial Sequence: Synthetic oligonucleotide
  Target: SOD1; (-) strand; PAM type: NRG; PAM sequence: CAG
gtcgccctggaaatgtccaa

SEQ ID NO: 7846 - DNA, 20 bp, Artificial Sequence
  Description of Artificial Sequence: Synthetic oligonucleotide
  Target: SOD1; (-) strand; PAM type: NRG; PAM sequence: TGG
aaaaaaagaaaaagtcgccc

SEQ ID NO: 7847 - DNA, 20 bp, Artificial Sequence
  Description of Artificial Sequence: Synthetic oligonucleotide
  Target: SOD1; (-) strand; PAM type: NRG; PAM sequence: AAG
tttaaaaaaaaaaaaagaaa

SEQ ID NO: 7848 - DNA, 20 bp, Artificial Sequence
  Description of Artificial Sequence: Synthetic oligonucleotide
  Target: SOD1; (-) strand; PAM type: NRG; PAM sequence: AAG
cttgactttaaaaaaaaaaa

SEQ ID NO: 7849 - DNA, 20 bp, Artificial Sequence
  Description of Artificial Sequence: Synthetic oligonucleotide
  Target: SOD1; (-) strand; PAM type: NRG; PAM sequence: TGG
cacgcacacccttttccata

SEQ ID NO: 7850 - DNA, 20 bp, Artificial Sequence
  Description of Artificial Sequence: Synthetic oligonucleotide
  Target: SOD1; (-) strand; PAM type: NRG; PAM sequence: GAG
atgtctcatcctacactctg

SEQ ID NO: 7851 - DNA, 20 bp, Artificial Sequence
  Description of Artificial Sequence: Synthetic oligonucleotide
  Target: SOD1; (-) strand; PAM type: NRG; PAM sequence: TGG
gtatgtctcatcctacactc

SEQ ID NO: 7852 - DNA, 20 bp, Artificial Sequence
  Description of Artificial Sequence: Synthetic oligonucleotide
  Target: SOD1; (-) strand; PAM type: NRG; PAM sequence: AGG
ctcagcctttttaacccaaa

SEQ ID NO: 7853 - DNA, 20 bp, Artificial Sequence
  Description of Artificial Sequence: Synthetic oligonucleotide
  Target: SOD1; (-) strand; PAM type: NRG; PAM sequence: AAG
cctcagcctttttaacccaa

SEQ ID NO: 7854 - DNA, 20 bp, Artificial Sequence
  Description of Artificial Sequence: Synthetic oligonucleotide
  Target: SOD1; (-) strand; PAM type: NRG; PAM sequence: CAG
ttcacgccattctcctgcct

SEQ ID NO: 7855 - DNA, 20 bp, Artificial Sequence
  Description of Artificial Sequence: Synthetic oligonucleotide
  Target: SOD1; (-) strand; PAM type: NRG; PAM sequence: GGG
cactgcaagctccgcctccc

SEQ ID NO: 7856 - DNA, 20 bp, Artificial Sequence
  Description of Artificial Sequence: Synthetic oligonucleotide
  Target: SOD1; (-) strand; PAM type: NRG; PAM sequence: CGG
tcactgcaagctccgcctcc

SEQ ID NO: 7857 - DNA, 20 bp, Artificial Sequence
  Description of Artificial Sequence: Synthetic oligonucleotide
  Target: SOD1; (-) strand; PAM type: NRG; PAM sequence: AAG
gcatgatctcagctcactgc

SEQ ID NO: 7858 - DNA, 20 bp, Artificial Sequence
  Description of Artificial Sequence: Synthetic oligonucleotide
  Target: SOD1; (-) strand; PAM type: NRG; PAM sequence: CAG
ggagtgcagtggcatgatct

SEQ ID NO: 7859 - DNA, 20 bp, Artificial Sequence
  Description of Artificial Sequence: Synthetic oligonucleotide
  Target: SOD1; (-) strand; PAM type: NRG; PAM sequence: TGG
tcgcccaggctggagtgcag

SEQ ID NO: 7860 - DNA, 20 bp, Artificial Sequence
  Description of Artificial Sequence: Synthetic oligonucleotide
  Target: SOD1; (-) strand; PAM type: NRG; PAM sequence: CAG
ctgtcgcccaggctggagtg

SEQ ID NO: 7861 - DNA, 20 bp, Artificial Sequence
  Description of Artificial Sequence: Synthetic oligonucleotide
  Target: SOD1; (-) strand; PAM type: NRG; PAM sequence: GAG
tcgctctgtcgcccaggctg

SEQ ID NO: 7862 - DNA, 20 bp, Artificial Sequence
  Description of Artificial Sequence: Synthetic oligonucleotide
  Target: SOD1; (-) strand; PAM type: NRG; PAM sequence: TGG
tctcgctctgtcgcccaggc

SEQ ID NO: 7863 - DNA, 20 bp, Artificial Sequence
  Description of Artificial Sequence: Synthetic oligonucleotide
  Target: SOD1; (-) strand; PAM type: NRG; PAM sequence: AGG
agagtctcgctctgtcgccc

SEQ ID NO: 7864 - DNA, 20 bp, Artificial Sequence
  Description of Artificial Sequence: Synthetic oligonucleotide
  Target: SOD1; (-) strand; PAM type: NRG; PAM sequence: CAG
aagagtctcgctctgtcgcc

SEQ ID NO: 7865 - DNA, 20 bp, Artificial Sequence
  Description of Artificial Sequence: Synthetic oligonucleotide
  Target: SOD1; (-) strand; PAM type: NRG; PAM sequence: GAG
cgttttttattttgagacaa

SEQ ID NO: 7866 - DNA, 20 bp, Artificial Sequence
  Description of Artificial Sequence: Synthetic oligonucleotide
  Target: SOD1; (-) strand; PAM type: NRG; PAM sequence: AAG
aacgttttttattttgagac

SEQ ID NO: 7867 - DNA, 20 bp, Artificial Sequence
  Description of Artificial Sequence: Synthetic oligonucleotide
  Target: SOD1; (-) strand; PAM type: NRG; PAM sequence: GAG
atgtaaacgttttttatttt

SEQ ID NO: 7868 - DNA, 20 bp, Artificial Sequence
  Description of Artificial Sequence: Synthetic oligonucleotide
  Target: SOD1; (-) strand; PAM type: NRG; PAM sequence: AGG
tgtagtaaatacttttgaat

SEQ ID NO: 7869 - DNA, 20 bp, Artificial Sequence
  Description of Artificial Sequence: Synthetic oligonucleotide
  Target: SOD1; (-) strand; PAM type: NRG; PAM sequence: TAG
atgtagtaaatacttttgaa

SEQ ID NO: 7870 - DNA, 20 bp, Artificial Sequence
  Description of Artificial Sequence: Synthetic oligonucleotide
  Target: SOD1; (-) strand; PAM type: NRG; PAM sequence: TAG
aatgtaagtacctatttatg

SEQ ID NO: 7871 - DNA, 20 bp, Artificial Sequence
  Description of Artificial Sequence: Synthetic oligonucleotide
  Target: SOD1; (-) strand; PAM type: NRG; PAM sequence: AAG
ttacagtaaataggtaatgt

SEQ ID NO: 7872 - DNA, 20 bp, Artificial Sequence
  Description of Artificial Sequence: Synthetic oligonucleotide
  Target: SOD1; (-) strand; PAM type: NRG; PAM sequence: AGG
ctttgactattacagtaaat

SEQ ID NO: 7873 - DNA, 20 bp, Artificial Sequence
  Description of Artificial Sequence: Synthetic oligonucleotide
  Target: SOD1; (-) strand; PAM type: NRG; PAM sequence: TAG
gctttgactattacagtaaa

SEQ ID NO: 7874 - DNA, 20 bp, Artificial Sequence
  Description of Artificial Sequence: Synthetic oligonucleotide
  Target: SOD1; (-) strand; PAM type: NRG; PAM sequence: CAG
ttcataggctttgactatta

SEQ ID NO: 7875 - DNA, 20 bp, Artificial Sequence
  Description of Artificial Sequence: Synthetic oligonucleotide
  Target: SOD1; (-) strand; PAM type: NRG; PAM sequence: AGG
atcagtgttagatacttcat

SEQ ID NO: 7876 - DNA, 20 bp, Artificial Sequence
  Description of Artificial Sequence: Synthetic oligonucleotide
  Target: SOD1; (-) strand; PAM type: NRG; PAM sequence: TAG
catcagtgttagatacttca

SEQ ID NO: 7877 - DNA, 20 bp, Artificial Sequence
  Description of Artificial Sequence: Synthetic oligonucleotide
  Target: SOD1; (-) strand; PAM type: NRG; PAM sequence: TAG
gagtacctacacatcagtgt

SEQ ID NO: 7878 - DNA, 20 bp, Artificial Sequence
  Description of Artificial Sequence: Synthetic oligonucleotide
  Target: SOD1; (-) strand; PAM type: NRG; PAM sequence: CAG
caaagtgagtacctacacat

SEQ ID NO: 7879 - DNA, 20 bp, Artificial Sequence
  Description of Artificial Sequence: Synthetic oligonucleotide
  Target: SOD1; (-) strand; PAM type: NRG; PAM sequence: GAG
aatagagtggcaagcaaagt

SEQ ID NO: 7880 - DNA, 20 bp, Artificial Sequence
  Description of Artificial Sequence: Synthetic oligonucleotide
  Target: SOD1; (-) strand; PAM type: NRG; PAM sequence: AAG
acctaatagagtggcaagca

SEQ ID NO: 7881 - DNA, 20 bp, Artificial Sequence
  Description of Artificial Sequence: Synthetic oligonucleotide
  Target: SOD1; (-) strand; PAM type: NRG; PAM sequence: AAG
aaagcacctaatagagtggc

SEQ ID NO: 7882 - DNA, 20 bp, Artificial Sequence
  Description of Artificial Sequence: Synthetic oligonucleotide
  Target: SOD1; (-) strand; PAM type: NRG; PAM sequence: TGG
ataaaaagcacctaatagag

SEQ ID NO: 7883 - DNA, 20 bp, Artificial Sequence
  Description of Artificial Sequence: Synthetic oligonucleotide
  Target: SOD1; (-) strand; PAM type: NRG; PAM sequence: GAG
aacataaaaagcacctaata

SEQ ID NO: 7884 - DNA, 20 bp, Artificial Sequence
  Description of Artificial Sequence: Synthetic oligonucleotide
  Target: SOD1; (-) strand; PAM type: NRG; PAM sequence: TAG
ataacataaaaagcacctaa

SEQ ID NO: 7885 - DNA, 20 bp, Artificial Sequence
  Description of Artificial Sequence: Synthetic oligonucleotide
  Target: SOD1; (-) strand; PAM type: NRG; PAM sequence: AAG
tcatgattaaataacataaa

SEQ ID NO: 7886 - DNA, 20 bp, Artificial Sequence
  Description of Artificial Sequence: Synthetic oligonucleotide
  Target: SOD1; (-) strand; PAM type: NRG; PAM sequence: AGG
tgcacaagcaccctgtggcc

SEQ ID NO: 7887 - DNA, 20 bp, Artificial Sequence
  Description of Artificial Sequence: Synthetic oligonucleotide
  Target: SOD1; (-) strand; PAM type: NRG; PAM sequence: CAG
atgcacaagcaccctgtggc

SEQ ID NO: 7888 - DNA, 20 bp, Artificial Sequence
  Description of Artificial Sequence: Synthetic oligonucleotide
  Target: SOD1; (-) strand; PAM type: NRG; PAM sequence: TGG
ctcaatgcacaagcaccctg

SEQ ID NO: 7889 - DNA, 20 bp, Artificial Sequence
  Description of Artificial Sequence: Synthetic oligonucleotide
  Target: SOD1; (-) strand; PAM type: NRG; PAM sequence: AAG
tgttcccacactcaatgcac

SEQ ID NO: 7890 - DNA, 20 bp, Artificial Sequence
  Description of Artificial Sequence: Synthetic oligonucleotide
  Target: SOD1; (-) strand; PAM type: NRG; PAM sequence: TGG
ctgtgtcctcaaaagggaga

SEQ ID NO: 7891 - DNA, 20 bp, Artificial Sequence
  Description of Artificial Sequence: Synthetic oligonucleotide
  Target: SOD1; (-) strand; PAM type: NRG; PAM sequence: GAG
aggcctgtgtcctcaaaagg

SEQ ID NO: 7892 - DNA, 20 bp, Artificial Sequence
  Description of Artificial Sequence: Synthetic oligonucleotide
  Target: SOD1; (-) strand; PAM type: NRG; PAM sequence: GGG
ctaggcctgtgtcctcaaaa

SEQ ID NO: 7893 - DNA, 20 bp, Artificial Sequence
  Description of Artificial Sequence: Synthetic oligonucleotide
  Target: SOD1; (-) strand; PAM type: NRG; PAM sequence: AGG
tctaggcctgtgtcctcaaa

SEQ ID NO: 7894 - DNA, 20 bp, Artificial Sequence
  Description of Artificial Sequence: Synthetic oligonucleotide
  Target: SOD1; (-) strand; PAM type: NRG; PAM sequence: AAG
ctctaggcctgtgtcctcaa

SEQ ID NO: 7895 - DNA, 20 bp, Artificial Sequence
  Description of Artificial Sequence: Synthetic oligonucleotide
  Target: SOD1; (-) strand; PAM type: NRG; PAM sequence: AGG
gcaagctgcttaactgctct

SEQ ID NO: 7896 - DNA, 20 bp, Artificial Sequence
  Description of Artificial Sequence: Synthetic oligonucleotide
  Target: SOD1; (-) strand; PAM type: NRG; PAM sequence: TAG
agcaagctgcttaactgctc

SEQ ID NO: 7897 - DNA, 20 bp, Artificial Sequence
  Description of Artificial Sequence: Synthetic oligonucleotide
  Target: SOD1; (-) strand; PAM type: NRG; PAM sequence: AAG
ctagccagtgaacctccagc

SEQ ID NO: 7898 - DNA, 20 bp, Artificial Sequence
  Description of Artificial Sequence: Synthetic oligonucleotide
  Target: SOD1; (-) strand; PAM type: NRG; PAM sequence: CAG
ctttctagccagtgaacctc

SEQ ID NO: 7899 - DNA, 20 bp, Artificial Sequence
  Description of Artificial Sequence: Synthetic oligonucleotide
  Target: SOD1; (-) strand; PAM type: NRG; PAM sequence: CAG
caggctgaccactttctagc

SEQ ID NO: 7900 - DNA, 20 bp, Artificial Sequence
  Description of Artificial Sequence: Synthetic oligonucleotide
  Target: SOD1; (-) strand; PAM type: NRG; PAM sequence: TAG
atcccaggctgaccactttc

SEQ ID NO: 7901 - DNA, 20 bp, Artificial Sequence
  Description of Artificial Sequence: Synthetic oligonucleotide
  Target: SOD1; (-) strand; PAM type: NRG; PAM sequence: AGG
aaaatctgtgtccaaatccc

SEQ ID NO: 7902 - DNA, 20 bp, Artificial Sequence
  Description of Artificial Sequence: Synthetic oligonucleotide
  Target: SOD1; (-) strand; PAM type: NRG; PAM sequence: CAG
aaaaatctgtgtccaaatcc

SEQ ID NO: 7903 - DNA, 20 bp, Artificial Sequence
  Description of Artificial Sequence: Synthetic oligonucleotide
  Target: SOD1; (-) strand; PAM type: NRG; PAM sequence: TGG
aaagcagccagacttgggag

SEQ ID NO: 7904 - DNA, 20 bp, Artificial Sequence
  Description of Artificial Sequence: Synthetic oligonucleotide
  Target: SOD1; (-) strand; PAM type: NRG; PAM sequence: GAG
taaaaagcagccagacttgg

SEQ ID NO: 7905 - DNA, 20 bp, Artificial Sequence
  Description of Artificial Sequence: Synthetic oligonucleotide
  Target: SOD1; (-) strand; PAM type: NRG; PAM sequence: GGG
agtaaaaagcagccagactt

SEQ ID NO: 7906 - DNA, 20 bp, Artificial Sequence
  Description of Artificial Sequence: Synthetic oligonucleotide
  Target: SOD1; (-) strand; PAM type: NRG; PAM sequence: TGG
aagtaaaaagcagccagact

SEQ ID NO: 7907 - DNA, 20 bp, Artificial Sequence
  Description of Artificial Sequence: Synthetic oligonucleotide
  Target: SOD1; (-) strand; PAM type: NRG; PAM sequence: CAG
acagtgaagtaaaaagcagc

SEQ ID NO: 7908 - DNA, 20 bp, Artificial Sequence
  Description of Artificial Sequence: Synthetic oligonucleotide
  Target: SOD1; (-) strand; PAM type: NRG; PAM sequence: CAG
cctcacagtgaagtaaaaag

SEQ ID NO: 7909 - DNA, 20 bp, Artificial Sequence
  Description of Artificial Sequence: Synthetic oligonucleotide
  Target: SOD1; (-) strand; PAM type: NRG; PAM sequence: AAG
acccctcacagtgaagtaaa

SEQ ID NO: 7910 - DNA, 20 bp, Artificial Sequence
  Description of Artificial Sequence: Synthetic oligonucleotide
  Target: SOD1; (-) strand; PAM type: NRG; PAM sequence: AAG
tacctttacccctcacagtg

SEQ ID NO: 7911 - DNA, 20 bp, Artificial Sequence
  Description of Artificial Sequence: Synthetic oligonucleotide
  Target: SOD1; (-) strand; PAM type: NRG; PAM sequence: CAG
tgatttacctttacccctca

SEQ ID NO: 7912 - DNA, 20 bp, Artificial Sequence
  Description of Artificial Sequence: Synthetic oligonucleotide
  Target: SOD1; (-) strand; PAM type: NRG; PAM sequence: CAG
gagtttctgaacaaagaaaa

SEQ ID NO: 7913 - DNA, 20 bp, Artificial Sequence
  Description of Artificial Sequence: Synthetic oligonucleotide
  Target: SOD1; (-) strand; PAM type: NRG; PAM sequence: AAG
ttggagagagtttctgaaca

SEQ ID NO: 7914 - DNA, 20 bp, Artificial Sequence
  Description of Artificial Sequence: Synthetic oligonucleotide
  Target: SOD1; (-) strand; PAM type: NRG; PAM sequence: GAG
gaaaagtgcaaagttggaga

SEQ ID NO: 7915 - DNA, 20 bp, Artificial Sequence
  Description of Artificial Sequence: Synthetic oligonucleotide
  Target: SOD1; (-) strand; PAM type: NRG; PAM sequence: GAG
aagaaaagtgcaaagttgga

SEQ ID NO: 7916 - DNA, 20 bp, Artificial Sequence
  Description of Artificial Sequence: Synthetic oligonucleotide
  Target: SOD1; (-) strand; PAM type: NRG; PAM sequence: GAG
ttaagaaaagtgcaaagttg

SEQ ID NO: 7917 - DNA, 20 bp, Artificial Sequence
  Description of Artificial Sequence: Synthetic oligonucleotide
  Target: SOD1; (-) strand; PAM type: NRG; PAM sequence: TGG
ctttaagaaaagtgcaaagt

SEQ ID NO: 7918 - DNA, 20 bp, Artificial Sequence
  Description of Artificial Sequence: Synthetic oligonucleotide
  Target: SOD1; (-) strand; PAM type: NRG; PAM sequence: AAG
tttcctttaagaaaagtgca

SEQ ID NO: 7919 - DNA, 20 bp, Artificial Sequence
  Description of Artificial Sequence: Synthetic oligonucleotide
  Target: SOD1; (-) strand; PAM type: NRG; PAM sequence: AAG
ccattactttcctttaagaa

SEQ ID NO: 7920 - DNA, 20 bp, Artificial Sequence
  Description of Artificial Sequence: Synthetic oligonucleotide
  Target: SOD1; (-) strand; PAM type: NRG; PAM sequence: AAG
ctggtccattactttccttt

SEQ ID NO: 7921 - DNA, 20 bp, Artificial Sequence
  Description of Artificial Sequence: Synthetic oligonucleotide
  Target: SOD1; (-) strand; PAM type: NRG; PAM sequence: TGG
atgcttccccacaccttcac

SEQ ID NO: 7922 - DNA, 20 bp, Artificial Sequence
  Description of Artificial Sequence: Synthetic oligonucleotide
  Target: SOD1; (-) strand; PAM type: NRG; PAM sequence: CAG
aatccatgcaggccttcagt

SEQ ID NO: 7923 - DNA, 20 bp, Artificial Sequence
  Description of Artificial Sequence: Synthetic oligonucleotide
  Target: SOD1; (-) strand; PAM type: NRG; PAM sequence: CAG
atggaatccatgcaggcctt

SEQ ID NO: 7924 - DNA, 20 bp, Artificial Sequence
  Description of Artificial Sequence: Synthetic oligonucleotide
  Target: SOD1; (-) strand; PAM type: NRG; PAM sequence: AGG
catgaacatggaatccatgc

SEQ ID NO: 7925 - DNA, 20 bp, Artificial Sequence
  Description of Artificial Sequence: Synthetic oligonucleotide
  Target: SOD1; (-) strand; PAM type: NRG; PAM sequence: CAG
tcatgaacatggaatccatg

SEQ ID NO: 7926 - DNA, 20 bp, Artificial Sequence
  Description of Artificial Sequence: Synthetic oligonucleotide
  Target: SOD1; (-) strand; PAM type: NRG; PAM sequence: TGG
tatctccaaactcatgaaca

SEQ ID NO: 7927 - DNA, 20 bp, Artificial Sequence
  Description of Artificial Sequence: Synthetic oligonucleotide
  Target: SOD1; (-) strand; PAM type: NRG; PAM sequence: CAG
acaagtatgggtcaccagca

SEQ ID NO: 7928 - DNA, 20 bp, Artificial Sequence
  Description of Artificial Sequence: Synthetic oligonucleotide
  Target: SOD1; (-) strand; PAM type: NRG; PAM sequence: CAG
ggtgaacaagtatgggtcac

SEQ ID NO: 7929 - DNA, 20 bp, Artificial Sequence
  Description of Artificial Sequence: Synthetic oligonucleotide
  Target: SOD1; (-) strand; PAM type: NRG; PAM sequence: GGG
taactagggtgaacaagtat

SEQ ID NO: 7930 - DNA, 20 bp, Artificial Sequence
  Description of Artificial Sequence: Synthetic oligonucleotide
  Target: SOD1; (-) strand; PAM type: NRG; PAM sequence: TGG
ctaactagggtgaacaagta

SEQ ID NO: 7931 - DNA, 20 bp, Artificial Sequence
  Description of Artificial Sequence: Synthetic oligonucleotide
  Target: SOD1; (-) strand; PAM type: NRG; PAM sequence: AAG
tttatctaactagggtgaac

SEQ ID NO: 7932 - DNA, 20 bp, Artificial Sequence
  Description of Artificial Sequence: Synthetic oligonucleotide
  Target: SOD1; (-) strand; PAM type: NRG; PAM sequence: GGG
ctctactgtttatctaacta

SEQ ID NO: 7933 - DNA, 20 bp, Artificial Sequence
  Description of Artificial Sequence: Synthetic oligonucleotide
  Target: SOD1; (-) strand; PAM type: NRG; PAM sequence: AGG
actctactgtttatctaact

SEQ ID NO: 7934 - DNA, 20 bp, Artificial Sequence
  Description of Artificial Sequence: Synthetic oligonucleotide
  Target: SOD1; (-) strand; PAM type: NRG; PAM sequence: TAG
tactctactgtttatctaac

SEQ ID NO: 7935 - DNA, 20 bp, Artificial Sequence
  Description of Artificial Sequence: Synthetic oligonucleotide
  Target: SOD1; (-) strand; PAM type: NRG; PAM sequence: GGG
tgaggggttttaacgtttag

SEQ ID NO: 7936 - DNA, 20 bp, Artificial Sequence
  Description of Artificial Sequence: Synthetic oligonucleotide
  Target: SOD1; (-) strand; PAM type: NRG; PAM sequence: GGG
ttgaggggttttaacgttta

SEQ ID NO: 7937 - DNA, 20 bp, Artificial Sequence
  Description of Artificial Sequence: Synthetic oligonucleotide
  Target: SOD1; (-) strand; PAM type: NRG; PAM sequence: AGG
gttgaggggttttaacgttt

SEQ ID NO: 7938 - DNA, 20 bp, Artificial Sequence
  Description of Artificial Sequence: Synthetic oligonucleotide
  Target: SOD1; (-) strand; PAM type: NRG; PAM sequence: TAG
agttgaggggttttaacgtt

SEQ ID NO: 7939 - DNA, 20 bp, Artificial Sequence
  Description of Artificial Sequence: Synthetic oligonucleotide
  Target: SOD1; (-) strand; PAM type: NRG; PAM sequence: GGG
aaaaacaaaaacaagttgag

SEQ ID NO: 7940 - DNA, 20 bp, Artificial Sequence
  Description of Artificial Sequence: Synthetic oligonucleotide
  Target: SOD1; (-) strand; PAM type: NRG; PAM sequence: GGG
caaaaacaaaaacaagttga

SEQ ID NO: 7941 - DNA, 20 bp, Artificial Sequence
  Description of Artificial Sequence: Synthetic oligonucleotide
  Target: SOD1; (-) strand; PAM type: NRG; PAM sequence: AGG
tcaaaaacaaaaacaagttg

SEQ ID NO: 7942 - DNA, 20 bp, Artificial Sequence
  Description of Artificial Sequence: Synthetic oligonucleotide
  Target: SOD1; (-) strand; PAM type: NRG; PAM sequence: GAG
ctcaaaaacaaaaacaagtt

SEQ ID NO: 7943 - DNA, 20 bp, Artificial Sequence
  Description of Artificial Sequence: Synthetic oligonucleotide
  Target: SOD1; (-) strand; PAM type: NRG; PAM sequence: AAG
cctttctcaaaaacaaaaac

SEQ ID NO: 7944 - DNA, 20 bp, Artificial Sequence
  Description of Artificial Sequence: Synthetic oligonucleotide
  Target: SOD1; (-) strand; PAM type: NRG; PAM sequence: AAG
tccagcctgagcgacagagc

SEQ ID NO: 7945 - DNA, 20 bp, Artificial Sequence
  Description of Artificial Sequence: Synthetic oligonucleotide
  Target: SOD1; (-) strand; PAM type: NRG; PAM sequence: GAG
gcactccagcctgagcgaca

SEQ ID NO: 7946 - DNA, 20 bp, Artificial Sequence
  Description of Artificial Sequence: Synthetic oligonucleotide
  Target: SOD1; (-) strand; PAM type: NRG; PAM sequence: CAG
ctgcactccagcctgagcga

SEQ ID NO: 7947 - DNA, 20 bp, Artificial Sequence
  Description of Artificial Sequence: Synthetic oligonucleotide
  Target: SOD1; (-) strand; PAM type: NRG; PAM sequence: GAG
gcgccactgcactccagcct

SEQ ID NO: 7948 - DNA, 20 bp, Artificial Sequence
  Description of Artificial Sequence: Synthetic oligonucleotide
  Target: SOD1; (-) strand; PAM type: NRG; PAM sequence: CAG
cgcacagcgccactgcactc

SEQ ID NO: 7949 - DNA, 20 bp, Artificial Sequence
  Description of Artificial Sequence: Synthetic oligonucleotide
  Target: SOD1; (-) strand; PAM type: NRG; PAM sequence: CAG
taaggtcagccatgatcgca

SEQ ID NO: 7950 - DNA, 20 bp, Artificial Sequence
  Description of Artificial Sequence: Synthetic oligonucleotide
  Target: SOD1; (-) strand; PAM type: NRG; PAM sequence: CAG
tgggaggtcaaggctaaggt

SEQ ID NO: 7951 - DNA, 20 bp, Artificial Sequence
  Description of Artificial Sequence: Synthetic oligonucleotide
  Target: SOD1; (-) strand; PAM type: NRG; PAM sequence: AGG
agcctgggaggtcaaggcta

SEQ ID NO: 7952 - DNA, 20 bp, Artificial Sequence
  Description of Artificial Sequence: Synthetic oligonucleotide
  Target: SOD1; (-) strand; PAM type: NRG; PAM sequence: AAG
gagcctgggaggtcaaggct

SEQ ID NO: 7953 - DNA, 20 bp, Artificial Sequence
  Description of Artificial Sequence: Synthetic oligonucleotide
  Target: SOD1; (-) strand; PAM type: NRG; PAM sequence: AGG
caatggagcctgggaggtca

SEQ ID NO: 7954 - DNA, 20 bp, Artificial Sequence
  Description of Artificial Sequence: Synthetic oligonucleotide
  Target: SOD1; (-) strand; PAM type: NRG; PAM sequence: AAG
tcaatggagcctgggaggtc

SEQ ID NO: 7955 - DNA, 20 bp, Artificial Sequence
  Description of Artificial Sequence: Synthetic oligonucleotide
  Target: SOD1; (-) strand; PAM type: NRG; PAM sequence: AGG
gaggatcaatggagcctggg

SEQ ID NO: 7956 - DNA, 20 bp, Artificial Sequence
  Description of Artificial Sequence: Synthetic oligonucleotide
  Target: SOD1; (-) strand; PAM type: NRG; PAM sequence: GAG
tgaggatcaatggagcctgg

SEQ ID NO: 7957 - DNA, 20 bp, Artificial Sequence
  Description of Artificial Sequence: Synthetic oligonucleotide
  Target: SOD1; (-) strand; PAM type: NRG; PAM sequence: GGG
catgaggatcaatggagcct

SEQ ID NO: 7958 - DNA, 20 bp, Artificial Sequence
  Description of Artificial Sequence: Synthetic oligonucleotide
  Target: SOD1; (-) strand; PAM type: NRG; PAM sequence: TGG
gcatgaggatcaatggagcc

SEQ ID NO: 7959 - DNA, 20 bp, Artificial Sequence
  Description of Artificial Sequence: Synthetic oligonucleotide
  Target: SOD1; (-) strand; PAM type: NRG; PAM sequence: GAG
ccaaggcatgaggatcaatg

SEQ ID NO: 7960 - DNA, 20 bp, Artificial Sequence
  Description of Artificial Sequence: Synthetic oligonucleotide
  Target: SOD1; (-) strand; PAM type: NRG; PAM sequence: TGG
ggccaaggcatgaggatcaa

SEQ ID NO: 7961 - DNA, 20 bp, Artificial Sequence
  Description of Artificial Sequence: Synthetic oligonucleotide
  Target: SOD1; (-) strand; PAM type: NRG; PAM sequence: AGG
cagctacgggccaaggcatg

SEQ ID NO: 7962 - DNA, 20 bp, Artificial Sequence
  Description of Artificial Sequence: Synthetic oligonucleotide
  Target: SOD1; (-) strand; PAM type: NRG; PAM sequence: GAG
ccagctacgggccaaggcat

SEQ ID NO: 7963 - DNA, 20 bp, Artificial Sequence
  Description of Artificial Sequence: Synthetic oligonucleotide
  Target: SOD1; (-) strand; PAM type: NRG; PAM sequence: AGG
gtagtcccagctacgggcca

SEQ ID NO: 7964 - DNA, 20 bp, Artificial Sequence
  Description of Artificial Sequence: Synthetic oligonucleotide
  Target: SOD1; (-) strand; PAM type: NRG; PAM sequence: AAG
tgtagtcccagctacgggcc

SEQ ID NO: 7965 - DNA, 20 bp, Artificial Sequence
  Description of Artificial Sequence: Synthetic oligonucleotide
  Target: SOD1; (-) strand; PAM type: NRG; PAM sequence: GGG
gtacctgtagtcccagctac

SEQ ID NO: 7966 - DNA, 20 bp, Artificial Sequence
  Description of Artificial Sequence: Synthetic oligonucleotide
  Target: SOD1; (-) strand; PAM type: NRG; PAM sequence: CGG
tgtacctgtagtcccagcta

SEQ ID NO: 7967 - DNA, 20 bp, Artificial Sequence
  Description of Artificial Sequence: Synthetic oligonucleotide
  Target: SOD1; (-) strand; PAM type: NRG; PAM sequence: CAG
gtggtgtgtacctgtagtcc

SEQ ID NO: 7968 - DNA, 20 bp, Artificial Sequence
  Description of Artificial Sequence: Synthetic oligonucleotide
  Target: SOD1; (-) strand; PAM type: NRG; PAM sequence: TAG
ggcgtggtggtgtgtacctg

SEQ ID NO: 7969 - DNA, 20 bp, Artificial Sequence
  Description of Artificial Sequence: Synthetic oligonucleotide
  Target: SOD1; (-) strand; PAM type: NRG; PAM sequence: TGG
caaaaattagccaggcgtgg

SEQ ID NO: 7970 - DNA, 20 bp, Artificial Sequence
  Description of Artificial Sequence: Synthetic oligonucleotide
  Target: SOD1; (-) strand; PAM type: NRG; PAM sequence: TGG
atacaaaaattagccaggcg

SEQ ID NO: 7971 - DNA, 20 bp, Artificial Sequence
  Description of Artificial Sequence: Synthetic oligonucleotide
  Target: SOD1; (-) strand; PAM type: NRG; PAM sequence: AGG
aaaaaatacaaaaattagcc

SEQ ID NO: 7972 - DNA, 20 bp, Artificial Sequence
  Description of Artificial Sequence: Synthetic oligonucleotide
  Target: SOD1; (-) strand; PAM type: NRG; PAM sequence: CAG
aaaaaaatacaaaaattagc

SEQ ID NO: 7973 - DNA, 20 bp, Artificial Sequence
  Description of Artificial Sequence: Synthetic oligonucleotide
  Target: SOD1; (-) strand; PAM type: NRG; PAM sequence: TAG
ctagaaaaaaatacaaaaat

SEQ ID NO: 7974 - DNA, 20 bp, Artificial Sequence
  Description of Artificial Sequence: Synthetic oligonucleotide
  Target: SOD1; (-) strand; PAM type: NRG; PAM sequence: TAG
acatgatgaaaccccacctc

SEQ ID NO: 7975 - DNA, 20 bp, Artificial Sequence
  Description of Artificial Sequence: Synthetic oligonucleotide
  Target: SOD1; (-) strand; PAM type: NRG; PAM sequence: GGG
cagcagttcaagaccagcct

SEQ ID NO: 7976 - DNA, 20 bp, Artificial Sequence
  Description of Artificial Sequence: Synthetic oligonucleotide
  Target: SOD1; (-) strand; PAM type: NRG; PAM sequence: TGG
ccagcagttcaagaccagcc

SEQ ID NO: 7977 - DNA, 20 bp, Artificial Sequence
  Description of Artificial Sequence: Synthetic oligonucleotide
  Target: SOD1; (-) strand; PAM type: NRG; PAM sequence: CAG
tgagcccagcagttcaagac

SEQ ID NO: 7978 - DNA, 20 bp, Artificial Sequence
  Description of Artificial Sequence: Synthetic oligonucleotide
  Target: SOD1; (-) strand; PAM type: NRG; PAM sequence: AAG
ccacttgagcccagcagttc

SEQ ID NO: 7979 - DNA, 20 bp, Artificial Sequence
  Description of Artificial Sequence: Synthetic oligonucleotide
  Target: SOD1; (-) strand; PAM type: NRG; PAM sequence: CAG
gatagaccacttgagcccag

SEQ ID NO: 7980 - DNA, 20 bp, Artificial Sequence
  Description of Artificial Sequence: Synthetic oligonucleotide
  Target: SOD1; (-) strand; PAM type: NRG; PAM sequence: CAG
gaggatagaccacttgagcc

SEQ ID NO: 7981 - DNA, 20 bp, Artificial Sequence
  Description of Artificial Sequence: Synthetic oligonucleotide
  Target: SOD1; (-) strand; PAM type: NRG; PAM sequence: GAG
tcgaggaggatagaccactt

SEQ ID NO: 7982 - DNA, 20 bp, Artificial Sequence
  Description of Artificial Sequence: Synthetic oligonucleotide
  Target: SOD1; (-) strand; PAM type: NRG; PAM sequence: TAG
ctttgggaggtcgaggagga

SEQ ID NO: 7983 - DNA, 20 bp, Artificial Sequence
  Description of Artificial Sequence: Synthetic oligonucleotide
  Target: SOD1; (-) strand; PAM type: NRG; PAM sequence: AGG
agcactttgggaggtcgagg

SEQ ID NO: 7984 - DNA, 20 bp, Artificial Sequence
  Description of Artificial Sequence: Synthetic oligonucleotide
  Target: SOD1; (-) strand; PAM type: NRG; PAM sequence: GAG
cagcactttgggaggtcgag

SEQ ID NO: 7985 - DNA, 20 bp, Artificial Sequence
  Description of Artificial Sequence: Synthetic oligonucleotide
  Target: SOD1; (-) strand; PAM type: NRG; PAM sequence: AGG
cccagcactttgggaggtcg

SEQ ID NO: 7986 - DNA, 20 bp, Artificial Sequence
  Description of Artificial Sequence: Synthetic oligonucleotide
  Target: SOD1; (-) strand; PAM type: NRG; PAM sequence: GAG
tcccagcactttgggaggtc

SEQ ID NO: 7987 - DNA, 20 bp, Artificial Sequence
  Description of Artificial Sequence: Synthetic oligonucleotide
  Target: SOD1; (-) strand; PAM type: NRG; PAM sequence: AGG
tgtaatcccagcactttggg

SEQ ID NO: 7988 - DNA, 20 bp, Artificial Sequence
  Description of Artificial Sequence: Synthetic oligonucleotide
  Target: SOD1; (-) strand; PAM type: NRG; PAM sequence: GAG
atgtaatcccagcactttgg

SEQ ID NO: 7989 - DNA, 20 bp, Artificial Sequence
  Description of Artificial Sequence: Synthetic oligonucleotide
  Target: SOD1; (-) strand; PAM type: NRG; PAM sequence: GGG
acatgtaatcccagcacttt

SEQ ID NO: 7990 - DNA, 20 bp, Artificial Sequence
  Description of Artificial Sequence: Synthetic oligonucleotide
  Target: SOD1; (-) strand; PAM type: NRG; PAM sequence: TGG
cacatgtaatcccagcactt

SEQ ID NO: 7991 - DNA, 20 bp, Artificial Sequence
  Description of Artificial Sequence: Synthetic oligonucleotide
  Target: SOD1; (-) strand; PAM type: NRG; PAM sequence: CAG
gtggctcacacatgtaatcc

SEQ ID NO: 7992 - DNA, 20 bp, Artificial Sequence
  Description of Artificial Sequence: Synthetic oligonucleotide
  Target: SOD1; (-) strand; PAM type: NRG; PAM sequence: TGG
gagggttttcccaggcacag

SEQ ID NO: 7993 - DNA, 20 bp, Artificial Sequence
  Description of Artificial Sequence: Synthetic oligonucleotide
  Target: SOD1; (-) strand; PAM type: NRG; PAM sequence: CAG
gttgagggttttcccaggca

SEQ ID NO: 7994 - DNA, 20 bp, Artificial Sequence
  Description of Artificial Sequence: Synthetic oligonucleotide
  Target: SOD1; (-) strand; PAM type: NRG; PAM sequence: AGG
gaaaagttgagggttttccc

SEQ ID NO: 7995 - DNA, 20 bp, Artificial Sequence
  Description of Artificial Sequence: Synthetic oligonucleotide
  Target: SOD1; (-) strand; PAM type: NRG; PAM sequence: CAG
agaaaagttgagggttttcc

SEQ ID NO: 7996 - DNA, 20 bp, Artificial Sequence
  Description of Artificial Sequence: Synthetic oligonucleotide
  Target: SOD1; (-) strand; PAM type: NRG; PAM sequence: GGG
ttttttaaaagaaaagttga

SEQ ID NO: 7997 - DNA, 20 bp, Artificial Sequence
  Description of Artificial Sequence: Synthetic oligonucleotide
  Target: SOD1; (-) strand; PAM type: NRG; PAM sequence: AGG
cttttttaaaagaaaagttg

SEQ ID NO: 7998 - DNA, 20 bp, Artificial Sequence
  Description of Artificial Sequence: Synthetic oligonucleotide
  Target: SOD1; (-) strand; PAM type: NRG; PAM sequence: GAG
tcttttttaaaagaaaagtt

SEQ ID NO: 7999 - DNA, 20 bp, Artificial Sequence
  Description of Artificial Sequence: Synthetic oligonucleotide
  Target: SOD1; (-) strand; PAM type: NRG; PAM sequence: AAG
tgacctcttttttaaaagaa

SEQ ID NO: 8000 - DNA, 20 bp, Artificial Sequence
  Description of Artificial Sequence: Synthetic oligonucleotide
  Target: SOD1; (-) strand; PAM type: NRG; PAM sequence: AAG
aaagttgacctcttttttaa

SEQ ID NO: 8001 - DNA, 20 bp, Artificial Sequence
  Description of Artificial Sequence: Synthetic oligonucleotide
  Target: SOD1; (-) strand; PAM type: NRG; PAM sequence: AAG
cacagtgcttatatacaata

SEQ ID NO: 8002 - DNA, 20 bp, Artificial Sequence
  Description of Artificial Sequence: Synthetic oligonucleotide
  Target: SOD1; (-) strand; PAM type: NRG; PAM sequence: CAG
cagttcctgcaattttagca

SEQ ID NO: 8003 - DNA, 20 bp, Artificial Sequence
  Description of Artificial Sequence: Synthetic oligonucleotide
  Target: SOD1; (-) strand; PAM type: NRG; PAM sequence: TAG
ggtcccagttcctgcaattt

SEQ ID NO: 8004 - DNA, 20 bp, Artificial Sequence
  Description of Artificial Sequence: Synthetic oligonucleotide
  Target: SOD1; (-) strand; PAM type: NRG; PAM sequence: CAG
caaaaatcaggatatggtcc

SEQ ID NO: 8005 - DNA, 20 bp, Artificial Sequence
  Description of Artificial Sequence: Synthetic oligonucleotide
  Target: SOD1; (-) strand; PAM type: NRG; PAM sequence: TGG
ttattacaaaaatcaggata

SEQ ID NO: 8006 - DNA, 20 bp, Artificial Sequence
  Description of Artificial Sequence: Synthetic oligonucleotide
  Target: SOD1; (-) strand; PAM type: NRG; PAM sequence: AGG
ctggcattattacaaaaatc

SEQ ID NO: 8007 - DNA, 20 bp, Artificial Sequence
  Description of Artificial Sequence: Synthetic oligonucleotide
  Target: SOD1; (-) strand; PAM type: NRG; PAM sequence: CAG
gctggcattattacaaaaat

SEQ ID NO: 8008 - DNA, 20 bp, Artificial Sequence
  Description of Artificial Sequence: Synthetic oligonucleotide
  Target: SOD1; (-) strand; PAM type: NRG; PAM sequence: TGG
ttttcttgtgtgtactctgc

SEQ ID NO: 8009 - DNA, 20 bp, Artificial Sequence
  Description of Artificial Sequence: Synthetic oligonucleotide
  Target: SOD1; (-) strand; PAM type: NRG; PAM sequence: CAG
ccagtcttcacaatctagtg

SEQ ID NO: 8010 - DNA, 20 bp, Artificial Sequence
  Description of Artificial Sequence: Synthetic oligonucleotide
  Target: SOD1; (-) strand; PAM type: NRG; PAM sequence: TAG
ccaccccagtcttcacaatc

SEQ ID NO: 8011 - DNA, 20 bp, Artificial Sequence
  Description of Artificial Sequence: Synthetic oligonucleotide
  Target: SOD1; (-) strand; PAM type: NRG; PAM sequence: CAG
cttcagaagcaggtccaccc

SEQ ID NO: 8012 - DNA, 20 bp, Artificial Sequence
  Description of Artificial Sequence: Synthetic oligonucleotide
  Target: SOD1; (-) strand; PAM type: NRG; PAM sequence: AGG
ggcactggaccttcagaagc

SEQ ID NO: 8013 - DNA, 20 bp, Artificial Sequence
  Description of Artificial Sequence: Synthetic oligonucleotide
  Target: SOD1; (-) strand; PAM type: NRG; PAM sequence: CAG
gggcactggaccttcagaag

SEQ ID NO: 8014 - DNA, 20 bp, Artificial Sequence
  Description of Artificial Sequence: Synthetic oligonucleotide
  Target: SOD1; (-) strand; PAM type: NRG; PAM sequence: AAG
aaagggcactggaccttcag

SEQ ID NO: 8015 - DNA, 20 bp, Artificial Sequence
  Description of Artificial Sequence: Synthetic oligonucleotide
  Target: SOD1; (-) strand; PAM type: NRG; PAM sequence: CAG
gacaaagggcactggacctt

SEQ ID NO: 8016 - DNA, 20 bp, Artificial Sequence
  Description of Artificial Sequence: Synthetic oligonucleotide
  Target: SOD1; (-) strand; PAM type: NRG; PAM sequence: TGG
aatcttaagacaaagggcac

SEQ ID NO: 8017 - DNA, 20 bp, Artificial Sequence
  Description of Artificial Sequence: Synthetic oligonucleotide
  Target: SOD1; (-) strand; PAM type: NRG; PAM sequence: GGG
acaccaaatcttaagacaaa

SEQ ID NO: 8018 - DNA, 20 bp, Artificial Sequence
  Description of Artificial Sequence: Synthetic oligonucleotide
  Target: SOD1; (-) strand; PAM type: NRG; PAM sequence: AGG
tacaccaaatcttaagacaa

SEQ ID NO: 8019 - DNA, 20 bp, Artificial Sequence
  Description of Artificial Sequence: Synthetic oligonucleotide
  Target: SOD1; (-) strand; PAM type: NRG; PAM sequence: AAG
ctacaccaaatcttaagaca

SEQ ID NO: 8020 - DNA, 20 bp, Artificial Sequence
  Description of Artificial Sequence: Synthetic oligonucleotide
  Target: SOD1; (-) strand; PAM type: NRG; PAM sequence: AAG
gacacactacaccaaatctt

SEQ ID NO: 8021 - DNA, 20 bp, Artificial Sequence
  Description of Artificial Sequence: Synthetic oligonucleotide
  Target: SOD1; (-) strand; PAM type: NRG; PAM sequence: AAG
ttctctttttttggtttcta

SEQ ID NO: 8022 - DNA, 20 bp, Artificial Sequence
  Description of Artificial Sequence: Synthetic oligonucleotide
  Target: SOD1; (-) strand; PAM type: NRG; PAM sequence: TGG
ttgatcttcttctctttttt

SEQ ID NO: 8023 - DNA, 20 bp, Artificial Sequence
  Description of Artificial Sequence: Synthetic oligonucleotide
  Target: SOD1; (-) strand; PAM type: NRG; PAM sequence: AGG
cagttttgtggctaatctta

SEQ ID NO: 8024 - DNA, 20 bp, Artificial Sequence
  Description of Artificial Sequence: Synthetic oligonucleotide
  Target: SOD1; (-) strand; PAM type: NRG; PAM sequence: AAG
ccagttttgtggctaatctt

SEQ ID NO: 8025 - DNA, 20 bp, Artificial Sequence
  Description of Artificial Sequence: Synthetic oligonucleotide
  Target: SOD1; (-) strand; PAM type: NRG; PAM sequence: TGG
ggtatcaaagcccagttttg

SEQ ID NO: 8026 - DNA, 20 bp, Artificial Sequence
  Description of Artificial Sequence: Synthetic oligonucleotide
  Target: SOD1; (-) strand; PAM type: NRG; PAM sequence: CAG
cacacctaggtatcaaagcc

SEQ ID NO: 8027 - DNA, 20 bp, Artificial Sequence
  Description of Artificial Sequence: Synthetic oligonucleotide
  Target: SOD1; (-) strand; PAM type: NRG; PAM sequence: AAG
ttttccacacctaggtatca

SEQ ID NO: 8028 - DNA, 20 bp, Artificial Sequence
  Description of Artificial Sequence: Synthetic oligonucleotide
  Target: SOD1; (-) strand; PAM type: NRG; PAM sequence: AGG
tccctttcttttccacacct

SEQ ID NO: 8029 - DNA, 20 bp, Artificial Sequence
  Description of Artificial Sequence: Synthetic oligonucleotide
  Target: SOD1; (-) strand; PAM type: NRG; PAM sequence: TAG
ttccctttcttttccacacc

SEQ ID NO: 8030 - DNA, 20 bp, Artificial Sequence
  Description of Artificial Sequence: Synthetic oligonucleotide
  Target: SOD1; (-) strand; PAM type: NRG; PAM sequence: AAG
ctcttctacaatgatgctgt

SEQ ID NO: 8031 - DNA, 20 bp, Artificial Sequence
  Description of Artificial Sequence: Synthetic oligonucleotide
  Target: SOD1; (-) strand; PAM type: NRG; PAM sequence: AAG
tccagcctgggccacagagt

SEQ ID NO: 8032 - DNA, 20 bp, Artificial Sequence
  Description of Artificial Sequence: Synthetic oligonucleotide
  Target: SOD1; (-) strand; PAM type: NRG; PAM sequence: GAG
gcactccagcctgggccaca

SEQ ID NO: 8033 - DNA, 20 bp, Artificial Sequence
  Description of Artificial Sequence: Synthetic oligonucleotide
  Target: SOD1; (-) strand; PAM type: NRG; PAM sequence: CAG
ctgcactccagcctgggcca

SEQ ID NO: 8034 - DNA, 20 bp, Artificial Sequence
  Description of Artificial Sequence: Synthetic oligonucleotide
  Target: SOD1; (-) strand; PAM type: NRG; PAM sequence: GGG
gcgccactgcactccagcct

SEQ ID NO: 8035 - DNA, 20 bp, Artificial Sequence
  Description of Artificial Sequence: Synthetic oligonucleotide
  Target: SOD1; (-) strand; PAM type: NRG; PAM sequence: TGG
cgcgccactgcactccagcc

SEQ ID NO: 8036 - DNA, 20 bp, Artificial Sequence
  Description of Artificial Sequence: Synthetic oligonucleotide
  Target: SOD1; (-) strand; PAM type: NRG; PAM sequence: CAG
gagatcgcgccactgcactc

SEQ ID NO: 8037 - DNA, 20 bp, Artificial Sequence
  Description of Artificial Sequence: Synthetic oligonucleotide
  Target: SOD1; (-) strand; PAM type: NRG; PAM sequence: GAG
ggcggagcttgcagtgagcc

SEQ ID NO: 8038 - DNA, 20 bp, Artificial Sequence
  Description of Artificial Sequence: Synthetic oligonucleotide
  Target: SOD1; (-) strand; PAM type: NRG; PAM sequence: GAG
cgggaggcggagcttgcagt

SEQ ID NO: 8039 - DNA, 20 bp, Artificial Sequence
  Description of Artificial Sequence: Synthetic oligonucleotide
  Target: SOD1; (-) strand; PAM type: NRG; PAM sequence: CAG
aacccgggaggcggagcttg

SEQ ID NO: 8040 - DNA, 20 bp, Artificial Sequence
  Description of Artificial Sequence: Synthetic oligonucleotide
  Target: SOD1; (-) strand; PAM type: NRG; PAM sequence: GAG
tggcatgaacccgggaggcg

SEQ ID NO: 8041 - DNA, 20 bp, Artificial Sequence
  Description of Artificial Sequence: Synthetic oligonucleotide
  Target: SOD1; (-) strand; PAM type: NRG; PAM sequence: CGG
aatggcatgaacccgggagg

SEQ ID NO: 8042 - DNA, 20 bp, Artificial Sequence
  Description of Artificial Sequence: Synthetic oligonucleotide
  Target: SOD1; (-) strand; PAM type: NRG; PAM sequence: AGG
gagaatggcatgaacccggg

SEQ ID NO: 8043 - DNA, 20 bp, Artificial Sequence
  Description of Artificial Sequence: Synthetic oligonucleotide
  Target: SOD1; (-) strand; PAM type: NRG; PAM sequence: GAG
ggagaatggcatgaacccgg

SEQ ID NO: 8044 - DNA, 20 bp, Artificial Sequence
  Description of Artificial Sequence: Synthetic oligonucleotide
  Target: SOD1; (-) strand; PAM type: NRG; PAM sequence: GGG
caggagaatggcatgaaccc

SEQ ID NO: 8045 - DNA, 20 bp, Artificial Sequence
  Description of Artificial Sequence: Synthetic oligonucleotide
  Target: SOD1; (-) strand; PAM type: NRG; PAM sequence: CGG
gcaggagaatggcatgaacc

SEQ ID NO: 8046 - DNA, 20 bp, Artificial Sequence
  Description of Artificial Sequence: Synthetic oligonucleotide
  Target: SOD1; (-) strand; PAM type: NRG; PAM sequence: TGG
agggggctgaggcaggagaa

SEQ ID NO: 8047 - DNA, 20 bp, Artificial Sequence
  Description of Artificial Sequence: Synthetic oligonucleotide
  Target: SOD1; (-) strand; PAM type: NRG; PAM sequence: GAG
tactcagggggctgaggcag

SEQ ID NO: 8048 - DNA, 20 bp, Artificial Sequence
  Description of Artificial Sequence: Synthetic oligonucleotide
  Target: SOD1; (-) strand; PAM type: NRG; PAM sequence: AGG
gctactcagggggctgaggc

SEQ ID NO: 8049 - DNA, 20 bp, Artificial Sequence
  Description of Artificial Sequence: Synthetic oligonucleotide
  Target: SOD1; (-) strand; PAM type: NRG; PAM sequence: CAG
agctactcagggggctgagg

SEQ ID NO: 8050 - DNA, 20 bp, Artificial Sequence
  Description of Artificial Sequence: Synthetic oligonucleotide
  Target: SOD1; (-) strand; PAM type: NRG; PAM sequence: AGG
cccagctactcagggggctg

SEQ ID NO: 8051 - DNA, 20 bp, Artificial Sequence
  Description of Artificial Sequence: Synthetic oligonucleotide
  Target: SOD1; (-) strand; PAM type: NRG; PAM sequence: GAG
tcccagctactcagggggct

SEQ ID NO: 8052 - DNA, 20 bp, Artificial Sequence
  Description of Artificial Sequence: Synthetic oligonucleotide
  Target: SOD1; (-) strand; PAM type: NRG; PAM sequence: GGG
tgtagtcccagctactcagg

SEQ ID NO: 8053 - DNA, 20 bp, Artificial Sequence
  Description of Artificial Sequence: Synthetic oligonucleotide
  Target: SOD1; (-) strand; PAM type: NRG; PAM sequence: GGG
ctgtagtcccagctactcag

SEQ ID NO: 8054 - DNA, 20 bp, Artificial Sequence
  Description of Artificial Sequence: Synthetic oligonucleotide
  Target: SOD1; (-) strand; PAM type: NRG; PAM sequence: GGG
cctgtagtcccagctactca

SEQ ID NO: 8055 - DNA, 20 bp, Artificial Sequence
  Description of Artificial Sequence: Synthetic oligonucleotide
  Target: SOD1; (-) strand; PAM type: NRG; PAM sequence: AGG
acctgtagtcccagctactc

SEQ ID NO: 8056 - DNA, 20 bp, Artificial Sequence
  Description of Artificial Sequence: Synthetic oligonucleotide
  Target: SOD1; (-) strand; PAM type: NRG; PAM sequence: CAG
cacctgtagtcccagctact

SEQ ID NO: 8057 - DNA, 20 bp, Artificial Sequence
  Description of Artificial Sequence: Synthetic oligonucleotide
  Target: SOD1; (-) strand; PAM type: NRG; PAM sequence: CAG
gtggcgggcacctgtagtcc

SEQ ID NO: 8058 - DNA, 20 bp, Artificial Sequence
  Description of Artificial Sequence: Synthetic oligonucleotide
  Target: SOD1; (-) strand; PAM type: NRG; PAM sequence: TAG
ggcggggtggcgggcacctg

SEQ ID NO: 8059 - DNA, 20 bp, Artificial Sequence
  Description of Artificial Sequence: Synthetic oligonucleotide
  Target: SOD1; (-) strand; PAM type: NRG; PAM sequence: GGG
aattagccaggcggggtggc

SEQ ID NO: 8060 - DNA, 20 bp, Artificial Sequence
  Description of Artificial Sequence: Synthetic oligonucleotide
  Target: SOD1; (-) strand; PAM type: NRG; PAM sequence: CGG
aaattagccaggcggggtgg

SEQ ID NO: 8061 - DNA, 20 bp, Artificial Sequence
  Description of Artificial Sequence: Synthetic oligonucleotide
  Target: SOD1; (-) strand; PAM type: NRG; PAM sequence: TGG
aaaaaattagccaggcgggg

SEQ ID NO: 8062 - DNA, 20 bp, Artificial Sequence
  Description of Artificial Sequence: Synthetic oligonucleotide
  Target: SOD1; (-) strand; PAM type: NRG; PAM sequence: GGG
tacaaaaaattagccaggcg

SEQ ID NO: 8063 - DNA, 20 bp, Artificial Sequence
  Description of Artificial Sequence: Synthetic oligonucleotide
  Target: SOD1; (-) strand; PAM type: NRG; PAM sequence: GGG
atacaaaaaattagccaggc

SEQ ID NO: 8064 - DNA, 20 bp, Artificial Sequence
  Description of Artificial Sequence: Synthetic oligonucleotide
  Target: SOD1; (-) strand; PAM type: NRG; PAM sequence: CGG
aatacaaaaaattagccagg

SEQ ID NO: 8065 - DNA, 20 bp, Artificial Sequence
  Description of Artificial Sequence: Synthetic oligonucleotide
  Target: SOD1; (-) strand; PAM type: NRG; PAM sequence: AGG
aaaaatacaaaaaattagcc

SEQ ID NO: 8066 - DNA, 20 bp, Artificial Sequence
  Description of Artificial Sequence: Synthetic oligonucleotide
  Target: SOD1; (-) strand; PAM type: NRG; PAM sequence: CAG
taaaaatacaaaaaattagc

SEQ ID NO: 8067 - DNA, 20 bp, Artificial Sequence
  Description of Artificial Sequence: Synthetic oligonucleotide
  Target: SOD1; (-) strand; PAM type: NRG; PAM sequence: TAG
ctactaaaaatacaaaaaat

SEQ ID NO: 8068 - DNA, 20 bp, Artificial Sequence
  Description of Artificial Sequence: Synthetic oligonucleotide
  Target: SOD1; (-) strand; PAM type: NRG; PAM sequence: CAG
agagaccatcttggctaaca

SEQ ID NO: 8069 - DNA, 20 bp, Artificial Sequence
  Description of Artificial Sequence: Synthetic oligonucleotide
  Target: SOD1; (-) strand; PAM type: NRG; PAM sequence: TGG
ggtcaggagagagaccatct

SEQ ID NO: 8070 - DNA, 20 bp, Artificial Sequence
  Description of Artificial Sequence: Synthetic oligonucleotide
  Target: SOD1; (-) strand; PAM type: NRG; PAM sequence: GAG
cggatcacgaggtcaggaga

SEQ ID NO: 8071 - DNA, 20 bp, Artificial Sequence
  Description of Artificial Sequence: Synthetic oligonucleotide
  Target: SOD1; (-) strand; PAM type: NRG; PAM sequence: GAG
ggcggatcacgaggtcagga

SEQ ID NO: 8072 - DNA, 20 bp, Artificial Sequence
  Description of Artificial Sequence: Synthetic oligonucleotide
  Target: SOD1; (-) strand; PAM type: NRG; PAM sequence: GAG
caggcggatcacgaggtcag

SEQ ID NO: 8073 - DNA, 20 bp, Artificial Sequence
  Description of Artificial Sequence: Synthetic oligonucleotide
  Target: SOD1; (-) strand; PAM type: NRG; PAM sequence: AGG
gacaggcggatcacgaggtc

SEQ ID NO: 8074 - DNA, 20 bp, Artificial Sequence
  Description of Artificial Sequence: Synthetic oligonucleotide
  Target: SOD1; (-) strand; PAM type: NRG; PAM sequence: CAG
agacaggcggatcacgaggt

SEQ ID NO: 8075 - DNA, 20 bp, Artificial Sequence
  Description of Artificial Sequence: Synthetic oligonucleotide
  Target: SOD1; (-) strand; PAM type: NRG; PAM sequence: AGG
gctgagacaggcggatcacg

SEQ ID NO: 8076 - DNA, 20 bp, Artificial Sequence
  Description of Artificial Sequence: Synthetic oligonucleotide
  Target: SOD1; (-) strand; PAM type: NRG; PAM sequence: GAG
ggctgagacaggcggatcac

SEQ ID NO: 8077 - DNA, 20 bp, Artificial Sequence
  Description of Artificial Sequence: Synthetic oligonucleotide
  Target: SOD1; (-) strand; PAM type: NRG; PAM sequence: CGG
ctttgggaggctgagacagg

SEQ ID NO: 8078 - DNA, 20 bp, Artificial Sequence
  Description of Artificial Sequence: Synthetic oligonucleotide
  Target: SOD1; (-) strand; PAM type: NRG; PAM sequence: AGG
gcactttgggaggctgagac

SEQ ID NO: 8079 - DNA, 20 bp, Artificial Sequence
  Description of Artificial Sequence: Synthetic oligonucleotide
  Target: SOD1; (-) strand; PAM type: NRG; PAM sequence: CAG
agcactttgggaggctgaga

SEQ ID NO: 8080 - DNA, 20 bp, Artificial Sequence
  Description of Artificial Sequence: Synthetic oligonucleotide
  Target: SOD1; (-) strand; PAM type: NRG; PAM sequence: GAG
tcccagcactttgggaggct

SEQ ID NO: 8081 - DNA, 20 bp, Artificial Sequence
  Description of Artificial Sequence: Synthetic oligonucleotide
  Target: SOD1; (-) strand; PAM type: NRG; PAM sequence: AGG
tgtaatcccagcactttggg

SEQ ID NO: 8082 - DNA, 20 bp, Artificial Sequence
  Description of Artificial Sequence: Synthetic oligonucleotide
  Target: SOD1; (-) strand; PAM type: NRG; PAM sequence: GAG
ctgtaatcccagcactttgg

SEQ ID NO: 8083 - DNA, 20 bp, Artificial Sequence
  Description of Artificial Sequence: Synthetic oligonucleotide
  Target: SOD1; (-) strand; PAM type: NRG; PAM sequence: GGG
gcctgtaatcccagcacttt

SEQ ID NO: 8084 - DNA, 20 bp, Artificial Sequence
  Description of Artificial Sequence: Synthetic oligonucleotide
  Target: SOD1; (-) strand; PAM type: NRG; PAM sequence: TGG
tgcctgtaatcccagcactt

SEQ ID NO: 8085 - DNA, 20 bp, Artificial Sequence
  Description of Artificial Sequence: Synthetic oligonucleotide
  Target: SOD1; (-) strand; PAM type: NRG; PAM sequence: CAG
gtggctcatgcctgtaatcc

SEQ ID NO: 8086 - DNA, 20 bp, Artificial Sequence
  Description of Artificial Sequence: Synthetic oligonucleotide
  Target: SOD1; (-) strand; PAM type: NRG; PAM sequence: TGG
cctcttctggctgggtgcgg

SEQ ID NO: 8087 - DNA, 20 bp, Artificial Sequence
  Description of Artificial Sequence: Synthetic oligonucleotide
  Target: SOD1; (-) strand; PAM type: NRG; PAM sequence: CGG
caccctcttctggctgggtg

SEQ ID NO: 8088 - DNA, 20 bp, Artificial Sequence
  Description of Artificial Sequence: Synthetic oligonucleotide
  Target: SOD1; (-) strand; PAM type: NRG; PAM sequence: GGG
aaaaacaccctcttctggct

SEQ ID NO: 8089 - DNA, 20 bp, Artificial Sequence
  Description of Artificial Sequence: Synthetic oligonucleotide
  Target: SOD1; (-) strand; PAM type: NRG; PAM sequence: TGG
aaaaaacaccctcttctggc

SEQ ID NO: 8090 - DNA, 20 bp, Artificial Sequence
  Description of Artificial Sequence: Synthetic oligonucleotide
  Target: SOD1; (-) strand; PAM type: NRG; PAM sequence: TGG
ctttaaaaaacaccctcttc

SEQ ID NO: 8091 - DNA, 20 bp, Artificial Sequence
  Description of Artificial Sequence: Synthetic oligonucleotide
  Target: SOD1; (-) strand; PAM type: NRG; PAM sequence: AAG
attacaaaagttaagagccc

SEQ ID NO: 8092 - DNA, 20 bp, Artificial Sequence
  Description of Artificial Sequence: Synthetic oligonucleotide
  Target: SOD1; (-) strand; PAM type: NRG; PAM sequence: GAG
gggatcattacaaaagttaa

SEQ ID NO: 8093 - DNA, 20 bp, Artificial Sequence
  Description of Artificial Sequence: Synthetic oligonucleotide
  Target: SOD1; (-) strand; PAM type: NRG; PAM sequence: AAG
ctgggatcattacaaaagtt

SEQ ID NO: 8094 - DNA, 20 bp, Artificial Sequence
  Description of Artificial Sequence: Synthetic oligonucleotide
  Target: SOD1; (-) strand; PAM type: NRG; PAM sequence: AAG
aacacctgggatcattacaa

SEQ ID NO: 8095 - DNA, 20 bp, Artificial Sequence
  Description of Artificial Sequence: Synthetic oligonucleotide
  Target: SOD1; (-) strand; PAM type: NRG; PAM sequence: GGG
aacccccagctcaaacacct

SEQ ID NO: 8096 - DNA, 20 bp, Artificial Sequence
  Description of Artificial Sequence: Synthetic oligonucleotide
  Target: SOD1; (-) strand; PAM type: NRG; PAM sequence: TGG
caacccccagctcaaacacc

SEQ ID NO: 8097 - DNA, 20 bp, Artificial Sequence
  Description of Artificial Sequence: Synthetic oligonucleotide
  Target: SOD1; (-) strand; PAM type: NRG; PAM sequence: CAG
aggcacccaccctcaacccc

SEQ ID NO: 8098 - DNA, 20 bp, Artificial Sequence
  Description of Artificial Sequence: Synthetic oligonucleotide
  Target: SOD1; (-) strand; PAM type: NRG; PAM sequence: AGG
aaatgcagcccctttgctcg

SEQ ID NO: 8099 - DNA, 20 bp, Artificial Sequence
  Description of Artificial Sequence: Synthetic oligonucleotide
  Target: SOD1; (-) strand; PAM type: NRG; PAM sequence: GAG
taaatgcagcccctttgctc

SEQ ID NO: 8100 - DNA, 20 bp, Artificial Sequence
  Description of Artificial Sequence: Synthetic oligonucleotide
  Target: SOD1; (-) strand; PAM type: NRG; PAM sequence: CAG
tggcattatgcaaataaatg

SEQ ID NO: 8101 - DNA, 20 bp, Artificial Sequence
  Description of Artificial Sequence: Synthetic oligonucleotide
  Target: SOD1; (-) strand; PAM type: NRG; PAM sequence: TGG
ggtgtagagctactcttaca

SEQ ID NO: 8102 - DNA, 20 bp, Artificial Sequence
  Description of Artificial Sequence: Synthetic oligonucleotide
  Target: SOD1; (-) strand; PAM type: NRG; PAM sequence: GAG
aagcctgtgtttggggtgta

SEQ ID NO: 8103 - DNA, 20 bp, Artificial Sequence
  Description of Artificial Sequence: Synthetic oligonucleotide
  Target: SOD1; (-) strand; PAM type: NRG; PAM sequence: TAG
agaagcctgtgtttggggtg

SEQ ID NO: 8104 - DNA, 20 bp, Artificial Sequence
  Description of Artificial Sequence: Synthetic oligonucleotide
  Target: SOD1; (-) strand; PAM type: NRG; PAM sequence: GGG
cactaagaagcctgtgtttg

SEQ ID NO: 8105 - DNA, 20 bp, Artificial Sequence
  Description of Artificial Sequence: Synthetic oligonucleotide
  Target: SOD1; (-) strand; PAM type: NRG; PAM sequence: GGG
ccactaagaagcctgtgttt

SEQ ID NO: 8106 - DNA, 20 bp, Artificial Sequence
  Description of Artificial Sequence: Synthetic oligonucleotide
  Target: SOD1; (-) strand; PAM type: NRG; PAM sequence: TGG
cccactaagaagcctgtgtt

SEQ ID NO: 8107 - DNA, 20 bp, Artificial Sequence
  Description of Artificial Sequence: Synthetic oligonucleotide
  Target: SOD1; (-) strand; PAM type: NRG; PAM sequence: AAG
catactttggtcccactaag

SEQ ID NO: 8108 - DNA, 20 bp, Artificial Sequence
  Description of Artificial Sequence: Synthetic oligonucleotide
  Target: SOD1; (-) strand; PAM type: NRG; PAM sequence: AAG
tatcatactttggtcccact

SEQ ID NO: 8109 - DNA, 20 bp, Artificial Sequence
  Description of Artificial Sequence: Synthetic oligonucleotide
  Target: SOD1; (-) strand; PAM type: NRG; PAM sequence: TGG
cttcagtttgtatcatactt

SEQ ID NO: 8110 - DNA, 20 bp, Artificial Sequence
  Description of Artificial Sequence: Synthetic oligonucleotide
  Target: SOD1; (-) strand; PAM type: NRG; PAM sequence: CAG
aatcctctgcattccatctt

SEQ ID NO: 8111 - DNA, 20 bp, Artificial Sequence
  Description of Artificial Sequence: Synthetic oligonucleotide
  Target: SOD1; (-) strand; PAM type: NRG; PAM sequence: AAG
ttttttttaagcatattcca

SEQ ID NO: 8112 - DNA, 20 bp, Artificial Sequence
  Description of Artificial Sequence: Synthetic oligonucleotide
  Target: SOD1; (-) strand; PAM type: NRG; PAM sequence: AAG
actttaaaaaaatttttttt

SEQ ID NO: 8113 - DNA, 20 bp, Artificial Sequence
  Description of Artificial Sequence: Synthetic oligonucleotide
  Target: SOD1; (-) strand; PAM type: NRG; PAM sequence: GGG
ctgaacctactctggttcag

SEQ ID NO: 8114 - DNA, 20 bp, Artificial Sequence
  Description of Artificial Sequence: Synthetic oligonucleotide
  Target: SOD1; (-) strand; PAM type: NRG; PAM sequence: GGG
tctgaacctactctggttca

SEQ ID NO: 8115 - DNA, 20 bp, Artificial Sequence
  Description of Artificial Sequence: Synthetic oligonucleotide
  Target: SOD1; (-) strand; PAM type: NRG; PAM sequence: AGG
ctctgaacctactctggttc

SEQ ID NO: 8116 - DNA, 20 bp, Artificial Sequence
  Description of Artificial Sequence: Synthetic oligonucleotide
  Target: SOD1; (-) strand; PAM type: NRG; PAM sequence: CAG
tctctgaacctactctggtt

SEQ ID NO: 8117 - DNA, 20 bp, Artificial Sequence
  Description of Artificial Sequence: Synthetic oligonucleotide
  Target: SOD1; (-) strand; PAM type: NRG; PAM sequence: TGG
cagtttctctgaacctactc

SEQ ID NO: 8118 - DNA, 20 bp, Artificial Sequence
  Description of Artificial Sequence: Synthetic oligonucleotide
  Target: SOD1; (-) strand; PAM type: NRG; PAM sequence: CAG
attaagaaaataaaatttgg

SEQ ID NO: 8119 - DNA, 20 bp, Artificial Sequence
  Description of Artificial Sequence: Synthetic oligonucleotide
  Target: SOD1; (-) strand; PAM type: NRG; PAM sequence: TGG
caaattaagaaaataaaatt

SEQ ID NO: 8120 - DNA, 20 bp, Artificial Sequence
  Description of Artificial Sequence: Synthetic oligonucleotide
  Target: SOD1; (-) strand; PAM type: NRG; PAM sequence: AAG
cttgcttccaatcccaaatt

SEQ ID NO: 8121 - DNA, 20 bp, Artificial Sequence
  Description of Artificial Sequence: Synthetic oligonucleotide
  Target: SOD1; (-) strand; PAM type: NRG; PAM sequence: AAG
ttattactcaaatatggcaa

SEQ ID NO: 8122 - DNA, 20 bp, Artificial Sequence
  Description of Artificial Sequence: Synthetic oligonucleotide
  Target: SOD1; (-) strand; PAM type: NRG; PAM sequence: TGG
atcagattattactcaaata

SEQ ID NO: 8123 - DNA, 20 bp, Artificial Sequence
  Description of Artificial Sequence: Synthetic oligonucleotide
  Target: SOD1; (-) strand; PAM type: NRG; PAM sequence: CAG
aaatctataaacaaaaaaat

SEQ ID NO: 8124 - DNA, 20 bp, Artificial Sequence
  Description of Artificial Sequence: Synthetic oligonucleotide
  Target: SOD1; (-) strand; PAM type: NRG; PAM sequence: AAG
atgaataaagttaatttaag

SEQ ID NO: 8125 - DNA, 20 bp, Artificial Sequence
  Description of Artificial Sequence: Synthetic oligonucleotide
  Target: SOD1; (-) strand; PAM type: NRG; PAM sequence: AAG
aagatgaataaagttaattt

SEQ ID NO: 8126 - DNA, 20 bp, Artificial Sequence
  Description of Artificial Sequence: Synthetic oligonucleotide
  Target: SOD1; (-) strand; PAM type: NRG; PAM sequence: AAG
ctaaattagcaagatgaata

SEQ ID NO: 8127 - DNA, 20 bp, Artificial Sequence
  Description of Artificial Sequence: Synthetic oligonucleotide
  Target: SOD1; (-) strand; PAM type: NRG; PAM sequence: AAG
ctatttgaaactaaattagc

SEQ ID NO: 8128 - DNA, 20 bp, Artificial Sequence
  Description of Artificial Sequence: Synthetic oligonucleotide
  Target: SOD1; (-) strand; PAM type: NRG; PAM sequence: TAG
atcactatttgaaactaaat

SEQ ID NO: 8129 - DNA, 20 bp, Artificial Sequence
  Description of Artificial Sequence: Synthetic oligonucleotide
  Target: SOD1; (-) strand; PAM type: NRG; PAM sequence: TGG
aatttcagcaattacagaaa

SEQ ID NO: 8130 - DNA, 20 bp, Artificial Sequence
  Description of Artificial Sequence: Synthetic oligonucleotide
  Target: SOD1; (-) strand; PAM type: NRG; PAM sequence: CAG
cgggggaatttcagcaatta

SEQ ID NO: 8131 - DNA, 20 bp, Artificial Sequence
  Description of Artificial Sequence: Synthetic oligonucleotide
  Target: SOD1; (-) strand; PAM type: NRG; PAM sequence: CAG
aaagcaactcgggggaattt

SEQ ID NO: 8132 - DNA, 20 bp, Artificial Sequence
  Description of Artificial Sequence: Synthetic oligonucleotide
  Target: SOD1; (-) strand; PAM type: NRG; PAM sequence: GGG
aaagccaaaaagcaactcgg

SEQ ID NO: 8133 - DNA, 20 bp, Artificial Sequence
  Description of Artificial Sequence: Synthetic oligonucleotide
  Target: SOD1; (-) strand; PAM type: NRG; PAM sequence: GGG
taaagccaaaaagcaactcg

SEQ ID NO: 8134 - DNA, 20 bp, Artificial Sequence
  Description of Artificial Sequence: Synthetic oligonucleotide
  Target: SOD1; (-) strand; PAM type: NRG; PAM sequence: GGG
gtaaagccaaaaagcaactc

SEQ ID NO: 8135 - DNA, 20 bp, Artificial Sequence
  Description of Artificial Sequence: Synthetic oligonucleotide
  Target: SOD1; (-) strand; PAM type: NRG; PAM sequence: CGG
ggtaaagccaaaaagcaact

SEQ ID NO: 8136 - DNA, 20 bp, Artificial Sequence
  Description of Artificial Sequence: Synthetic oligonucleotide
  Target: SOD1; (-) strand; PAM type: NRG; PAM sequence: AAG
ccagaggcggtaaagccaaa

SEQ ID NO: 8137 - DNA, 20 bp, Artificial Sequence
  Description of Artificial Sequence: Synthetic oligonucleotide
  Target: SOD1; (-) strand; PAM type: NRG; PAM sequence: AAG
ctcccagaccagaggcggta

SEQ ID NO: 8138 - DNA, 20 bp, Artificial Sequence
  Description of Artificial Sequence: Synthetic oligonucleotide
  Target: SOD1; (-) strand; PAM type: NRG; PAM sequence: CGG
atcacctcccagaccagagg

SEQ ID NO: 8139 - DNA, 20 bp, Artificial Sequence
  Description of Artificial Sequence: Synthetic oligonucleotide
  Target: SOD1; (-) strand; PAM type: NRG; PAM sequence: AGG
gcaatcacctcccagaccag

SEQ ID NO: 8140 - DNA, 20 bp, Artificial Sequence
  Description of Artificial Sequence: Synthetic oligonucleotide
  Target: SOD1; (-) strand; PAM type: NRG; PAM sequence: GAG
agcaatcacctcccagacca

SEQ ID NO: 8141 - DNA, 20 bp, Artificial Sequence
  Description of Artificial Sequence: Synthetic oligonucleotide
  Target: SOD1; (-) strand; PAM type: NRG; PAM sequence: CAG
agagcaatcacctcccagac

SEQ ID NO: 8142 - DNA, 20 bp, Artificial Sequence
  Description of Artificial Sequence: Synthetic oligonucleotide
  Target: SOD1; (-) strand; PAM type: NRG; PAM sequence: CAG
gcagcagagcaatcacctcc

SEQ ID NO: 8143 - DNA, 20 bp, Artificial Sequence
  Description of Artificial Sequence: Synthetic oligonucleotide
  Target: SOD1; (-) strand; PAM type: NRG; PAM sequence: GAG
gcaagttacaggaagcagca

SEQ ID NO: 8144 - DNA, 20 bp, Artificial Sequence
  Description of Artificial Sequence: Synthetic oligonucleotide
  Target: SOD1; (-) strand; PAM type: NRG; PAM sequence: CAG
aggcaagttacaggaagcag

SEQ ID NO: 8145 - DNA, 20 bp, Artificial Sequence
  Description of Artificial Sequence: Synthetic oligonucleotide
  Target: SOD1; (-) strand; PAM type: NRG; PAM sequence: CAG
ggcaggcaagttacaggaag

SEQ ID NO: 8146 - DNA, 20 bp, Artificial Sequence
  Description of Artificial Sequence: Synthetic oligonucleotide
  Target: SOD1; (-) strand; PAM type: NRG; PAM sequence: AAG
aaaggcaggcaagttacagg

SEQ ID NO: 8147 - DNA, 20 bp, Artificial Sequence
  Description of Artificial Sequence: Synthetic oligonucleotide
  Target: SOD1; (-) strand; PAM type: NRG; PAM sequence: AGG
gagaaaggcaggcaagttac

SEQ ID NO: 8148 - DNA, 20 bp, Artificial Sequence
  Description of Artificial Sequence: Synthetic oligonucleotide
  Target: SOD1; (-) strand; PAM type: NRG; PAM sequence: CAG
ggagaaaggcaggcaagtta

SEQ ID NO: 8149 - DNA, 20 bp, Artificial Sequence
  Description of Artificial Sequence: Synthetic oligonucleotide
  Target: SOD1; (-) strand; PAM type: NRG; PAM sequence: AAG
acacagggagaaaggcaggc

SEQ ID NO: 8150 - DNA, 20 bp, Artificial Sequence
  Description of Artificial Sequence: Synthetic oligonucleotide
  Target: SOD1; (-) strand; PAM type: NRG; PAM sequence: AGG
tcccacacagggagaaaggc

SEQ ID NO: 8151 - DNA, 20 bp, Artificial Sequence
  Description of Artificial Sequence: Synthetic oligonucleotide
  Target: SOD1; (-) strand; PAM type: NRG; PAM sequence: CAG
gtcccacacagggagaaagg

SEQ ID NO: 8152 - DNA, 20 bp, Artificial Sequence
  Description of Artificial Sequence: Synthetic oligonucleotide
  Target: SOD1; (-) strand; PAM type: NRG; PAM sequence: AGG
ggagtcccacacagggagaa

SEQ ID NO: 8153 - DNA, 20 bp, Artificial Sequence
  Description of Artificial Sequence: Synthetic oligonucleotide
  Target: SOD1; (-) strand; PAM type: NRG; PAM sequence: AAG
aggagtcccacacagggaga

SEQ ID NO: 8154 - DNA, 20 bp, Artificial Sequence
  Description of Artificial Sequence: Synthetic oligonucleotide
  Target: SOD1; (-) strand; PAM type: NRG; PAM sequence: GAG
ccgcaggagtcccacacagg

SEQ ID NO: 8155 - DNA, 20 bp, Artificial Sequence
  Description of Artificial Sequence: Synthetic oligonucleotide
  Target: SOD1; (-) strand; PAM type: NRG; PAM sequence: GGG
acccgcaggagtcccacaca

SEQ ID NO: 8156 - DNA, 20 bp, Artificial Sequence
  Description of Artificial Sequence: Synthetic oligonucleotide
  Target: SOD1; (-) strand; PAM type: NRG; PAM sequence: AGG
cacccgcaggagtcccacac

SEQ ID NO: 8157 - DNA, 20 bp, Artificial Sequence
  Description of Artificial Sequence: Synthetic oligonucleotide
  Target: SOD1; (-) strand; PAM type: NRG; PAM sequence: CAG
tcacccgcaggagtcccaca

SEQ ID NO: 8158 - DNA, 20 bp, Artificial Sequence
  Description of Artificial Sequence: Synthetic oligonucleotide
  Target: SOD1; (-) strand; PAM type: NRG; PAM sequence: GAG
agccacgctctcacccgcag

SEQ ID NO: 8159 - DNA, 20 bp, Artificial Sequence
  Description of Artificial Sequence: Synthetic oligonucleotide
  Target: SOD1; (-) strand; PAM type: NRG; PAM sequence: AGG
tcagccacgctctcacccgc

SEQ ID NO: 8160 - DNA, 20 bp, Artificial Sequence
  Description of Artificial Sequence: Synthetic oligonucleotide
  Target: SOD1; (-) strand; PAM type: NRG; PAM sequence: CAG
ttcagccacgctctcacccg

SEQ ID NO: 8161 - DNA, 20 bp, Artificial Sequence
  Description of Artificial Sequence: Synthetic oligonucleotide
  Target: SOD1; (-) strand; PAM type: NRG; PAM sequence: CAG
tttcataacacggctgtctt

SEQ ID NO: 8162 - DNA, 20 bp, Artificial Sequence
  Description of Artificial Sequence: Synthetic oligonucleotide
  Target: SOD1; (-) strand; PAM type: NRG; PAM sequence: CGG
caggaggccctttcataaca

SEQ ID NO: 8163 - DNA, 20 bp, Artificial Sequence
  Description of Artificial Sequence: Synthetic oligonucleotide
  Target: SOD1; (-) strand; PAM type: NRG; PAM sequence: AGG
cacaacctcgacagcacagg

SEQ ID NO: 8164 - DNA, 20 bp, Artificial Sequence
  Description of Artificial Sequence: Synthetic oligonucleotide
  Target: SOD1; (-) strand; PAM type: NRG; PAM sequence: GAG
gcacaacctcgacagcacag

SEQ ID NO: 8165 - DNA, 20 bp, Artificial Sequence
  Description of Artificial Sequence: Synthetic oligonucleotide
  Target: SOD1; (-) strand; PAM type: NRG; PAM sequence: AGG
gagcacaacctcgacagcac

SEQ ID NO: 8166 - DNA, 20 bp, Artificial Sequence
  Description of Artificial Sequence: Synthetic oligonucleotide
  Target: SOD1; (-) strand; PAM type: NRG; PAM sequence: CAG
agagcacaacctcgacagca

SEQ ID NO: 8167 - DNA, 20 bp, Artificial Sequence
  Description of Artificial Sequence: Synthetic oligonucleotide
  Target: SOD1; (-) strand; PAM type: NRG; PAM sequence: CAG
ttcacagagcacaacctcga

SEQ ID NO: 8168 - DNA, 20 bp, Artificial Sequence
  Description of Artificial Sequence: Synthetic oligonucleotide
  Target: SOD1; (-) strand; PAM type: NRG; PAM sequence: GAG
accaggggatgacattcaca

SEQ ID NO: 8169 - DNA, 20 bp, Artificial Sequence
  Description of Artificial Sequence: Synthetic oligonucleotide
  Target: SOD1; (-) strand; PAM type: NRG; PAM sequence: CAG
gcaccaggggatgacattca

SEQ ID NO: 8170 - DNA, 20 bp, Artificial Sequence
  Description of Artificial Sequence: Synthetic oligonucleotide
  Target: SOD1; (-) strand; PAM type: NRG; PAM sequence: GGG
aaggtgctgctgtgcaccag

SEQ ID NO: 8171 - DNA, 20 bp, Artificial Sequence
  Description of Artificial Sequence: Synthetic oligonucleotide
  Target: SOD1; (-) strand; PAM type: NRG; PAM sequence: GGG
gaaggtgctgctgtgcacca

SEQ ID NO: 8172 - DNA, 20 bp, Artificial Sequence
  Description of Artificial Sequence: Synthetic oligonucleotide
  Target: SOD1; (-) strand; PAM type: NRG; PAM sequence: AGG
agaaggtgctgctgtgcacc

SEQ ID NO: 8173 - DNA, 20 bp, Artificial Sequence
  Description of Artificial Sequence: Synthetic oligonucleotide
  Target: SOD1; (-) strand; PAM type: NRG; PAM sequence: CAG
tagaaggtgctgctgtgcac

SEQ ID NO: 8174 - DNA, 20 bp, Artificial Sequence
  Description of Artificial Sequence: Synthetic oligonucleotide
  Target: SOD1; (-) strand; PAM type: NRG; PAM sequence: AGG
ccaactgtatcctgtgtaga

SEQ ID NO: 8175 - DNA, 20 bp, Artificial Sequence
  Description of Artificial Sequence: Synthetic oligonucleotide
  Target: SOD1; (-) strand; PAM type: NRG; PAM sequence: AAG
tccaactgtatcctgtgtag

SEQ ID NO: 8176 - DNA, 20 bp, Artificial Sequence
  Description of Artificial Sequence: Synthetic oligonucleotide
  Target: SOD1; (-) strand; PAM type: NRG; PAM sequence: TAG
cattccaactgtatcctgtg

SEQ ID NO: 8177 - DNA, 20 bp, Artificial Sequence
  Description of Artificial Sequence: Synthetic oligonucleotide
  Target: SOD1; (-) strand; PAM type: NRG; PAM sequence: CGG
ccttacacaactcgaggggg

SEQ ID NO: 8178 - DNA, 20 bp, Artificial Sequence
  Description of Artificial Sequence: Synthetic oligonucleotide
  Target: SOD1; (-) strand; PAM type: NRG; PAM sequence: GGG
ctgccttacacaactcgagg

SEQ ID NO: 8179 - DNA, 20 bp, Artificial Sequence
  Description of Artificial Sequence: Synthetic oligonucleotide
  Target: SOD1; (-) strand; PAM type: NRG; PAM sequence: GGG
gctgccttacacaactcgag

SEQ ID NO: 8180 - DNA, 20 bp, Artificial Sequence
  Description of Artificial Sequence: Synthetic oligonucleotide
  Target: SOD1; (-) strand; PAM type: NRG; PAM sequence: GGG
tgctgccttacacaactcga

SEQ ID NO: 8181 - DNA, 20 bp, Artificial Sequence
  Description of Artificial Sequence: Synthetic oligonucleotide
  Target: SOD1; (-) strand; PAM type: NRG; PAM sequence: AGG
ctgctgccttacacaactcg

SEQ ID NO: 8182 - DNA, 20 bp, Artificial Sequence
  Description of Artificial Sequence: Synthetic oligonucleotide
  Target: SOD1; (-) strand; PAM type: NRG; PAM sequence: GAG
gctgctgccttacacaactc

SEQ ID NO: 8183 - DNA, 20 bp, Artificial Sequence
  Description of Artificial Sequence: Synthetic oligonucleotide
  Target: SOD1; (-) strand; PAM type: NRG; PAM sequence: AGG
catcttatgtgcaagggcca

SEQ ID NO: 8184 - DNA, 20 bp, Artificial Sequence
  Description of Artificial Sequence: Synthetic oligonucleotide
  Target: SOD1; (-) strand; PAM type: NRG; PAM sequence: AAG
gcatcttatgtgcaagggcc

SEQ ID NO: 8185 - DNA, 20 bp, Artificial Sequence
  Description of Artificial Sequence: Synthetic oligonucleotide
  Target: SOD1; (-) strand; PAM type: NRG; PAM sequence: GGG
caacagcatcttatgtgcaa

SEQ ID NO: 8186 - DNA, 20 bp, Artificial Sequence
  Description of Artificial Sequence: Synthetic oligonucleotide
  Target: SOD1; (-) strand; PAM type: NRG; PAM sequence: AGG
tcaacagcatcttatgtgca

SEQ ID NO: 8187 - DNA, 20 bp, Artificial Sequence
  Description of Artificial Sequence: Synthetic oligonucleotide
  Target: SOD1; (-) strand; PAM type: NRG; PAM sequence: AAG
ttcaacagcatcttatgtgc

SEQ ID NO: 8188 - DNA, 20 bp, Artificial Sequence
  Description of Artificial Sequence: Synthetic oligonucleotide
  Target: SOD1; (-) strand; PAM type: NRG; PAM sequence: CAG
ggtgcaggcagaatattcaa

SEQ ID NO: 8189 - DNA, 20 bp, Artificial Sequence
  Description of Artificial Sequence: Synthetic oligonucleotide
  Target: SOD1; (-) strand; PAM type: NRG; PAM sequence: CAG
tgccctttacttggtgcagg

SEQ ID NO: 8190 - DNA, 20 bp, Artificial Sequence
  Description of Artificial Sequence: Synthetic oligonucleotide
  Target: SOD1; (-) strand; PAM type: NRG; PAM sequence: AGG
ctgtgccctttacttggtgc

SEQ ID NO: 8191 - DNA, 20 bp, Artificial Sequence
  Description of Artificial Sequence: Synthetic oligonucleotide
  Target: SOD1; (-) strand; PAM type: NRG; PAM sequence: CAG
tctgtgccctttacttggtg

SEQ ID NO: 8192 - DNA, 20 bp, Artificial Sequence
  Description of Artificial Sequence: Synthetic oligonucleotide
  Target: SOD1; (-) strand; PAM type: NRG; PAM sequence: TGG
ttctatctgtgccctttact

SEQ ID NO: 8193 - DNA, 20 bp, Artificial Sequence
  Description of Artificial Sequence: Synthetic oligonucleotide
  Target: SOD1; (-) strand; PAM type: NRG; PAM sequence: CAG
ccccagcaacatatgccaag

SEQ ID NO: 8194 - DNA, 20 bp, Artificial Sequence
  Description of Artificial Sequence: Synthetic oligonucleotide
  Target: SOD1; (-) strand; PAM type: NRG; PAM sequence: AAG
tctccccagcaacatatgcc

SEQ ID NO: 8195 - DNA, 20 bp, Artificial Sequence
  Description of Artificial Sequence: Synthetic oligonucleotide
  Target: SOD1; (-) strand; PAM type: NRG; PAM sequence: CAG
ttacaaaaaactcatctccc

SEQ ID NO: 8196 - DNA, 20 bp, Artificial Sequence
  Description of Artificial Sequence: Synthetic oligonucleotide
  Target: SOD1; (-) strand; PAM type: NRG; PAM sequence: TAG
gatccaaattcttaagaacg

SEQ ID NO: 8197 - DNA, 20 bp, Artificial Sequence
  Description of Artificial Sequence: Synthetic oligonucleotide
  Target: SOD1; (-) strand; PAM type: NRG; PAM sequence: AAG
tggttatgatccaaattctt

SEQ ID NO: 8198 - DNA, 20 bp, Artificial Sequence
  Description of Artificial Sequence: Synthetic oligonucleotide
  Target: SOD1; (-) strand; PAM type: NRG; PAM sequence: TGG
tttctattattaaaatccca

SEQ ID NO: 8199 - DNA, 20 bp, Artificial Sequence
  Description of Artificial Sequence: Synthetic oligonucleotide
  Target: SOD1; (-) strand; PAM type: NRG; PAM sequence: CAG
gggaccagactgatcttcaa

SEQ ID NO: 8200 - DNA, 20 bp, Artificial Sequence
  Description of Artificial Sequence: Synthetic oligonucleotide
  Target: SOD1; (-) strand; PAM type: NRG; PAM sequence: CAG
tcactgtaaaaataagggac

SEQ ID NO: 8201 - DNA, 20 bp, Artificial Sequence
  Description of Artificial Sequence: Synthetic oligonucleotide
  Target: SOD1; (-) strand; PAM type: NRG; PAM sequence: GGG
cttcttcactgtaaaaataa

SEQ ID NO: 8202 - DNA, 20 bp, Artificial Sequence
  Description of Artificial Sequence: Synthetic oligonucleotide
  Target: SOD1; (-) strand; PAM type: NRG; PAM sequence: AGG
gcttcttcactgtaaaaata

SEQ ID NO: 8203 - DNA, 20 bp, Artificial Sequence
  Description of Artificial Sequence: Synthetic oligonucleotide
  Target: SOD1; (-) strand; PAM type: NRG; PAM sequence: AAG
ggcttcttcactgtaaaaat

SEQ ID NO: 8204 - DNA, 20 bp, Artificial Sequence
  Description of Artificial Sequence: Synthetic oligonucleotide
  Target: SOD1; (-) strand; PAM type: NRG; PAM sequence: TGG
taacacccttctctgggctt

SEQ ID NO: 8205 - DNA, 20 bp, Artificial Sequence
  Description of Artificial Sequence: Synthetic oligonucleotide
  Target: SOD1; (-) strand; PAM type: NRG; PAM sequence: GGG
taaagttaacacccttctct

SEQ ID NO: 8206 - DNA, 20 bp, Artificial Sequence
  Description of Artificial Sequence: Synthetic oligonucleotide
  Target: SOD1; (-) strand; PAM type: NRG; PAM sequence: TGG
gtaaagttaacacccttctc

SEQ ID NO: 8207 - DNA, 20 bp, Artificial Sequence
  Description of Artificial Sequence: Synthetic oligonucleotide
  Target: SOD1; (-) strand; PAM type: NRG; PAM sequence: AAG
actactgtctgacacttgta

SEQ ID NO: 8208 - DNA, 20 bp, Artificial Sequence
  Description of Artificial Sequence: Synthetic oligonucleotide
  Target: SOD1; (-) strand; PAM type: NRG; PAM sequence: AAG
aaaaaaaaaaaaaccccacc

SEQ ID NO: 8209 - DNA, 20 bp, Artificial Sequence
  Description of Artificial Sequence: Synthetic oligonucleotide
  Target: SOD1; (-) strand; PAM type: NRG; PAM sequence: AAG
tccagcctgggcaacagagc

SEQ ID NO: 8210 - DNA, 20 bp, Artificial Sequence
  Description of Artificial Sequence: Synthetic oligonucleotide
  Target: SOD1; (-) strand; PAM type: NRG; PAM sequence: GAG
gcactccagcctgggcaaca

SEQ ID NO: 8211 - DNA, 20 bp, Artificial Sequence
  Description of Artificial Sequence: Synthetic oligonucleotide
  Target: SOD1; (-) strand; PAM type: NRG; PAM sequence: CAG
ctgcactccagcctgggcaa

SEQ ID NO: 8212 - DNA, 20 bp, Artificial Sequence
  Description of Artificial Sequence: Synthetic oligonucleotide
  Target: SOD1; (-) strand; PAM type: NRG; PAM sequence: GGG
gcaccactgcactccagcct

SEQ ID NO: 8213 - DNA, 20 bp, Artificial Sequence
  Description of Artificial Sequence: Synthetic oligonucleotide
  Target: SOD1; (-) strand; PAM type: NRG; PAM sequence: TGG
cgcaccactgcactccagcc

SEQ ID NO: 8214 - DNA, 20 bp, Artificial Sequence
  Description of Artificial Sequence: Synthetic oligonucleotide
  Target: SOD1; (-) strand; PAM type: NRG; PAM sequence: CAG
gagatcgcaccactgcactc

SEQ ID NO: 8215 - DNA, 20 bp, Artificial Sequence
  Description of Artificial Sequence: Synthetic oligonucleotide
  Target: SOD1; (-) strand; PAM type: NRG; PAM sequence: GAG
ggcagaggttgcagtgagct

SEQ ID NO: 8216 - DNA, 20 bp, Artificial Sequence
  Description of Artificial Sequence: Synthetic oligonucleotide
  Target: SOD1; (-) strand; PAM type: NRG; PAM sequence: GAG
tgggaggcagaggttgcagt

SEQ ID NO: 8217 - DNA, 20 bp, Artificial Sequence
  Description of Artificial Sequence: Synthetic oligonucleotide
  Target: SOD1; (-) strand; PAM type: NRG; PAM sequence: CAG
aacctgggaggcagaggttg

SEQ ID NO: 8218 - DNA, 20 bp, Artificial Sequence
  Description of Artificial Sequence: Synthetic oligonucleotide
  Target: SOD1; (-) strand; PAM type: NRG; PAM sequence: AGG
cgcttgaacctgggaggcag

SEQ ID NO: 8219 - DNA, 20 bp, Artificial Sequence
  Description of Artificial Sequence: Synthetic oligonucleotide
  Target: SOD1; (-) strand; PAM type: NRG; PAM sequence: GAG
tcgcttgaacctgggaggca

SEQ ID NO: 8220 - DNA, 20 bp, Artificial Sequence
  Description of Artificial Sequence: Synthetic oligonucleotide
  Target: SOD1; (-) strand; PAM type: NRG; PAM sequence: CAG
aatcgcttgaacctgggagg

SEQ ID NO: 8221 - DNA, 20 bp, Artificial Sequence
  Description of Artificial Sequence: Synthetic oligonucleotide
  Target: SOD1; (-) strand; PAM type: NRG; PAM sequence: AGG
gagaatcgcttgaacctggg

SEQ ID NO: 8222 - DNA, 20 bp, Artificial Sequence
  Description of Artificial Sequence: Synthetic oligonucleotide
  Target: SOD1; (-) strand; PAM type: NRG; PAM sequence: GAG
ggagaatcgcttgaacctgg

SEQ ID NO: 8223 - DNA, 20 bp, Artificial Sequence
  Description of Artificial Sequence: Synthetic oligonucleotide
  Target: SOD1; (-) strand; PAM type: NRG; PAM sequence: GGG
caggagaatcgcttgaacct

SEQ ID NO: 8224 - DNA, 20 bp, Artificial Sequence
  Description of Artificial Sequence: Synthetic oligonucleotide
  Target: SOD1; (-) strand; PAM type: NRG; PAM sequence: TGG
gcaggagaatcgcttgaacc

SEQ ID NO: 8225 - DNA, 20 bp, Artificial Sequence
  Description of Artificial Sequence: Synthetic oligonucleotide
  Target: SOD1; (-) strand; PAM type: NRG; PAM sequence: GAG
tacttagtaggctgaggcag

SEQ ID NO: 8226 - DNA, 20 bp, Artificial Sequence
  Description of Artificial Sequence: Synthetic oligonucleotide
  Target: SOD1; (-) strand; PAM type: NRG; PAM sequence: AGG
gctacttagtaggctgaggc

SEQ ID NO: 8227 - DNA, 20 bp, Artificial Sequence
  Description of Artificial Sequence: Synthetic oligonucleotide
  Target: SOD1; (-) strand; PAM type: NRG; PAM sequence: CAG
agctacttagtaggctgagg

SEQ ID NO: 8228 - DNA, 20 bp, Artificial Sequence
  Description of Artificial Sequence: Synthetic oligonucleotide
  Target: SOD1; (-) strand; PAM type: NRG; PAM sequence: AGG
cccagctacttagtaggctg

SEQ ID NO: 8229 - DNA, 20 bp, Artificial Sequence
  Description of Artificial Sequence: Synthetic oligonucleotide
  Target: SOD1; (-) strand; PAM type: NRG; PAM sequence: GAG
tcccagctacttagtaggct

SEQ ID NO: 8230 - DNA, 20 bp, Artificial Sequence
  Description of Artificial Sequence: Synthetic oligonucleotide
  Target: SOD1; (-) strand; PAM type: NRG; PAM sequence: AGG
tatagtcccagctacttagt

SEQ ID NO: 8231 - DNA, 20 bp, Artificial Sequence
  Description of Artificial Sequence: Synthetic oligonucleotide
  Target: SOD1; (-) strand; PAM type: NRG; PAM sequence: TAG
ctatagtcccagctacttag

SEQ ID NO: 8232 - DNA, 20 bp, Artificial Sequence
  Description of Artificial Sequence: Synthetic oligonucleotide
  Target: SOD1; (-) strand; PAM type: NRG; PAM sequence: TAG
cacctatagtcccagctact

SEQ ID NO: 8233 - DNA, 20 bp, Artificial Sequence
  Description of Artificial Sequence: Synthetic oligonucleotide
  Target: SOD1; (-) strand; PAM type: NRG; PAM sequence: CAG
gtggtgcgcacctatagtcc

SEQ ID NO: 8234 - DNA, 20 bp, Artificial Sequence
  Description of Artificial Sequence: Synthetic oligonucleotide
  Target: SOD1; (-) strand; PAM type: NRG; PAM sequence: TAG
ggcgtggtggtgcgcaccta

SEQ ID NO: 8235 - DNA, 20 bp, Artificial Sequence
  Description of Artificial Sequence: Synthetic oligonucleotide
  Target: SOD1; (-) strand; PAM type: NRG; PAM sequence: TGG
caaaaattagctaggcgtgg

SEQ ID NO: 8236 - DNA, 20 bp, Artificial Sequence
  Description of Artificial Sequence: Synthetic oligonucleotide
  Target: SOD1; (-) strand; PAM type: NRG; PAM sequence: TGG
atacaaaaattagctaggcg

SEQ ID NO: 8237 - DNA, 20 bp, Artificial Sequence
  Description of Artificial Sequence: Synthetic oligonucleotide
  Target: SOD1; (-) strand; PAM type: NRG; PAM sequence: AGG
aaaaaatacaaaaattagct

SEQ ID NO: 8238 - DNA, 20 bp, Artificial Sequence
  Description of Artificial Sequence: Synthetic oligonucleotide
  Target: SOD1; (-) strand; PAM type: NRG; PAM sequence: TAG
gaaaaaatacaaaaattagc

SEQ ID NO: 8239 - DNA, 20 bp, Artificial Sequence
  Description of Artificial Sequence: Synthetic oligonucleotide
  Target: SOD1; (-) strand; PAM type: NRG; PAM sequence: TAG
tactgaaaaaatacaaaaat

SEQ ID NO: 8240 - DNA, 20 bp, Artificial Sequence
  Description of Artificial Sequence: Synthetic oligonucleotide
  Target: SOD1; (-) strand; PAM type: NRG; PAM sequence: TAG
tgagaccagcctggccagca

SEQ ID NO: 8241 - DNA, 20 bp, Artificial Sequence
  Description of Artificial Sequence: Synthetic oligonucleotide
  Target: SOD1; (-) strand; PAM type: NRG; PAM sequence: CAG
gagtttgagaccagcctggc

SEQ ID NO: 8242 - DNA, 20 bp, Artificial Sequence
  Description of Artificial Sequence: Synthetic oligonucleotide
  Target: SOD1; (-) strand; PAM type: NRG; PAM sequence: TGG
tcaggagtttgagaccagcc

SEQ ID NO: 8243 - DNA, 20 bp, Artificial Sequence
  Description of Artificial Sequence: Synthetic oligonucleotide
  Target: SOD1; (-) strand; PAM type: NRG; PAM sequence: CAG
tgaggtcaggagtttgagac

SEQ ID NO: 8244 - DNA, 20 bp, Artificial Sequence
  Description of Artificial Sequence: Synthetic oligonucleotide
  Target: SOD1; (-) strand; PAM type: NRG; PAM sequence: GAG
tcatctgaggtcaggagttt

SEQ ID NO: 8245 - DNA, 20 bp, Artificial Sequence
  Description of Artificial Sequence: Synthetic oligonucleotide
  Target: SOD1; (-) strand; PAM type: NRG; PAM sequence: GAG
gctggatcatctgaggtcag

SEQ ID NO: 8246 - DNA, 20 bp, Artificial Sequence
  Description of Artificial Sequence: Synthetic oligonucleotide
  Target: SOD1; (-) strand; PAM type: NRG; PAM sequence: AGG
tggctggatcatctgaggtc

SEQ ID NO: 8247 - DNA, 20 bp, Artificial Sequence
  Description of Artificial Sequence: Synthetic oligonucleotide
  Target: SOD1; (-) strand; PAM type: NRG; PAM sequence: CAG
gtggctggatcatctgaggt

SEQ ID NO: 8248 - DNA, 20 bp, Artificial Sequence
  Description of Artificial Sequence: Synthetic oligonucleotide
  Target: SOD1; (-) strand; PAM type: NRG; PAM sequence: AGG
tgaggtggctggatcatctg

SEQ ID NO: 8249 - DNA, 20 bp, Artificial Sequence
  Description of Artificial Sequence: Synthetic oligonucleotide
  Target: SOD1; (-) strand; PAM type: NRG; PAM sequence: GAG
ctgaggtggctggatcatct

SEQ ID NO: 8250 - DNA, 20 bp, Artificial Sequence
  Description of Artificial Sequence: Synthetic oligonucleotide
  Target: SOD1; (-) strand; PAM type: NRG; PAM sequence: TGG
ctttgggaagctgaggtggc

SEQ ID NO: 8251 - DNA, 20 bp, Artificial Sequence
  Description of Artificial Sequence: Synthetic oligonucleotide
  Target: SOD1; (-) strand; PAM type: NRG; PAM sequence: TGG
agcactttgggaagctgagg

SEQ ID NO: 8252 - DNA, 20 bp, Artificial Sequence
  Description of Artificial Sequence: Synthetic oligonucleotide
  Target: SOD1; (-) strand; PAM type: NRG; PAM sequence: AGG
cccagcactttgggaagctg

SEQ ID NO: 8253 - DNA, 20 bp, Artificial Sequence
  Description of Artificial Sequence: Synthetic oligonucleotide
  Target: SOD1; (-) strand; PAM type: NRG; PAM sequence: GAG
ccccagcactttgggaagct

SEQ ID NO: 8254 - DNA, 20 bp, Artificial Sequence
  Description of Artificial Sequence: Synthetic oligonucleotide
  Target: SOD1; (-) strand; PAM type: NRG; PAM sequence: AAG
tggaaccccagcactttggg

SEQ ID NO: 8255 - DNA, 20 bp, Artificial Sequence
  Description of Artificial Sequence: Synthetic oligonucleotide
  Target: SOD1; (-) strand; PAM type: NRG; PAM sequence: GGG
acctggaaccccagcacttt

SEQ ID NO: 8256 - DNA, 20 bp, Artificial Sequence
  Description of Artificial Sequence: Synthetic oligonucleotide
  Target: SOD1; (-) strand; PAM type: NRG; PAM sequence: TGG
cacctggaaccccagcactt

SEQ ID NO: 8257 - DNA, 20 bp, Artificial Sequence
  Description of Artificial Sequence: Synthetic oligonucleotide
  Target: SOD1; (-) strand; PAM type: NRG; PAM sequence: CAG
gtggctaacacctggaaccc

SEQ ID NO: 8258 - DNA, 20 bp, Artificial Sequence
  Description of Artificial Sequence: Synthetic oligonucleotide
  Target: SOD1; (-) strand; PAM type: NRG; PAM sequence: TGG
caggcatggtggctaacacc

SEQ ID NO: 8259 - DNA, 20 bp, Artificial Sequence
  Description of Artificial Sequence: Synthetic oligonucleotide
  Target: SOD1; (-) strand; PAM type: NRG; PAM sequence: TGG
aagtctatggccaggcatgg

SEQ ID NO: 8260 - DNA, 20 bp, Artificial Sequence
  Description of Artificial Sequence: Synthetic oligonucleotide
  Target: SOD1; (-) strand; PAM type: NRG; PAM sequence: TGG
aacaagtctatggccaggca

SEQ ID NO: 8261 - DNA, 20 bp, Artificial Sequence
  Description of Artificial Sequence: Synthetic oligonucleotide
  Target: SOD1; (-) strand; PAM type: NRG; PAM sequence: AGG
acagaaacaagtctatggcc

SEQ ID NO: 8262 - DNA, 20 bp, Artificial Sequence
  Description of Artificial Sequence: Synthetic oligonucleotide
  Target: SOD1; (-) strand; PAM type: NRG; PAM sequence: CAG
aacagaaacaagtctatggc

SEQ ID NO: 8263 - DNA, 20 bp, Artificial Sequence
  Description of Artificial Sequence: Synthetic oligonucleotide
  Target: SOD1; (-) strand; PAM type: NRG; PAM sequence: TGG
agggaacagaaacaagtcta

SEQ ID NO: 8264 - DNA, 20 bp, Artificial Sequence
  Description of Artificial Sequence: Synthetic oligonucleotide
  Target: SOD1; (-) strand; PAM type: NRG; PAM sequence: AAG
agtgagaagggaacagaaac

SEQ ID NO: 8265 - DNA, 20 bp, Artificial Sequence
  Description of Artificial Sequence: Synthetic oligonucleotide
  Target: SOD1; (-) strand; PAM type: NRG; PAM sequence: CAG
cagccacagtgagaagggaa

SEQ ID NO: 8266 - DNA, 20 bp, Artificial Sequence
  Description of Artificial Sequence: Synthetic oligonucleotide
  Target: SOD1; (-) strand; PAM type: NRG; PAM sequence: GGG
tggtacagccacagtgagaa

SEQ ID NO: 8267 - DNA, 20 bp, Artificial Sequence
  Description of Artificial Sequence: Synthetic oligonucleotide
  Target: SOD1; (-) strand; PAM type: NRG; PAM sequence: AGG
ttggtacagccacagtgaga

SEQ ID NO: 8268 - DNA, 20 bp, Artificial Sequence
  Description of Artificial Sequence: Synthetic oligonucleotide
  Target: SOD1; (-) strand; PAM type: NRG; PAM sequence: AAG
cttggtacagccacagtgag

SEQ ID NO: 8269 - DNA, 20 bp, Artificial Sequence
  Description of Artificial Sequence: Synthetic oligonucleotide
  Target: SOD1; (-) strand; PAM type: NRG; PAM sequence: GAG
caccttggtacagccacagt

SEQ ID NO: 8270 - DNA, 20 bp, Artificial Sequence
  Description of Artificial Sequence: Synthetic oligonucleotide
  Target: SOD1; (-) strand; PAM type: NRG; PAM sequence: CAG
gcaacaccttggtacagcca

SEQ ID NO: 8271 - DNA, 20 bp, Artificial Sequence
  Description of Artificial Sequence: Synthetic oligonucleotide
  Target: SOD1; (-) strand; PAM type: NRG; PAM sequence: CAG
ggataagcaacaccttggta

SEQ ID NO: 8272 - DNA, 20 bp, Artificial Sequence
  Description of Artificial Sequence: Synthetic oligonucleotide
  Target: SOD1; (-) strand; PAM type: NRG; PAM sequence: TGG
ttctgggataagcaacacct

SEQ ID NO: 8273 - DNA, 20 bp, Artificial Sequence
  Description of Artificial Sequence: Synthetic oligonucleotide
  Target: SOD1; (-) strand; PAM type: NRG; PAM sequence: AAG
tgcatcacgacttctgggat

SEQ ID NO: 8274 - DNA, 20 bp, Artificial Sequence
  Description of Artificial Sequence: Synthetic oligonucleotide
  Target: SOD1; (-) strand; PAM type: NRG; PAM sequence: GGG
tgacctgcatcacgacttct

SEQ ID NO: 8275 - DNA, 20 bp, Artificial Sequence
  Description of Artificial Sequence: Synthetic oligonucleotide
  Target: SOD1; (-) strand; PAM type: NRG; PAM sequence: TGG
ctgacctgcatcacgacttc

SEQ ID NO: 8276 - DNA, 20 bp, Artificial Sequence
  Description of Artificial Sequence: Synthetic oligonucleotide
  Target: SOD1; (-) strand; PAM type: NRG; PAM sequence: AAG
gctaaaacttcccatggaga

SEQ ID NO: 8277 - DNA, 20 bp, Artificial Sequence
  Description of Artificial Sequence: Synthetic oligonucleotide
  Target: SOD1; (-) strand; PAM type: NRG; PAM sequence: GAG
cactgctaaaacttcccatg

SEQ ID NO: 8278 - DNA, 20 bp, Artificial Sequence
  Description of Artificial Sequence: Synthetic oligonucleotide
  Target: SOD1; (-) strand; PAM type: NRG; PAM sequence: TGG
aacactgctaaaacttccca

SEQ ID NO: 8279 - DNA, 20 bp, Artificial Sequence
  Description of Artificial Sequence: Synthetic oligonucleotide
  Target: SOD1; (-) strand; PAM type: NRG; PAM sequence: AAG
gttcccaaatacattctaaa

SEQ ID NO: 8280 - DNA, 20 bp, Artificial Sequence
  Description of Artificial Sequence: Synthetic oligonucleotide
  Target: SOD1; (-) strand; PAM type: NRG; PAM sequence: AAG
aaaagctaaattatgaatta

SEQ ID NO: 8281 - DNA, 20 bp, Artificial Sequence
  Description of Artificial Sequence: Synthetic oligonucleotide
  Target: SOD1; (-) strand; PAM type: NRG; PAM sequence: AAG
tttataagaagaagaaaaaa

SEQ ID NO: 8282 - DNA, 20 bp, Artificial Sequence
  Description of Artificial Sequence: Synthetic oligonucleotide
  Target: SOD1; (-) strand; PAM type: NRG; PAM sequence: AAG
tacagcctatttataagaag

SEQ ID NO: 8283 - DNA, 20 bp, Artificial Sequence
  Description of Artificial Sequence: Synthetic oligonucleotide
  Target: SOD1; (-) strand; PAM type: NRG; PAM sequence: AAG
tggtacagcctatttataag

SEQ ID NO: 8284 - DNA, 20 bp, Artificial Sequence
  Description of Artificial Sequence: Synthetic oligonucleotide
  Target: SOD1; (-) strand; PAM type: NRG; PAM sequence: AAG
cactggtacagcctatttat

SEQ ID NO: 8285 - DNA, 20 bp, Artificial Sequence
  Description of Artificial Sequence: Synthetic oligonucleotide
  Target: SOD1; (-) strand; PAM type: NRG; PAM sequence: CAG
agtgaggacctgcactggta

SEQ ID NO: 8286 - DNA, 20 bp, Artificial Sequence
  Description of Artificial Sequence: Synthetic oligonucleotide
  Target: SOD1; (-) strand; PAM type: NRG; PAM sequence: TGG
attaaagtgaggacctgcac

SEQ ID NO: 8287 - DNA, 20 bp, Artificial Sequence
  Description of Artificial Sequence: Synthetic oligonucleotide
  Target: SOD1; (-) strand; PAM type: NRG; PAM sequence: AGG
ctggatagaggattaaagtg

SEQ ID NO: 8288 - DNA, 20 bp, Artificial Sequence
  Description of Artificial Sequence: Synthetic oligonucleotide
  Target: SOD1; (-) strand; PAM type: NRG; PAM sequence: GAG
tctggatagaggattaaagt

SEQ ID NO: 8289 - DNA, 20 bp, Artificial Sequence
  Description of Artificial Sequence: Synthetic oligonucleotide
  Target: SOD1; (-) strand; PAM type: NRG; PAM sequence: AAG
gttttctggatagaggatta

SEQ ID NO: 8290 - DNA, 20 bp, Artificial Sequence
  Description of Artificial Sequence: Synthetic oligonucleotide
  Target: SOD1; (-) strand; PAM type: NRG; PAM sequence: AGG
ccaccgtgttttctggatag

SEQ ID NO: 8291 - DNA, 20 bp, Artificial Sequence
  Description of Artificial Sequence: Synthetic oligonucleotide
  Target: SOD1; (-) strand; PAM type: NRG; PAM sequence: GAG
cccaccgtgttttctggata

SEQ ID NO: 8292 - DNA, 20 bp, Artificial Sequence
  Description of Artificial Sequence: Synthetic oligonucleotide
  Target: SOD1; (-) strand; PAM type: NRG; PAM sequence: TAG
ggcccaccgtgttttctgga

SEQ ID NO: 8293 - DNA, 20 bp, Artificial Sequence
  Description of Artificial Sequence: Synthetic oligonucleotide
  Target: SOD1; (-) strand; PAM type: NRG; PAM sequence: TGG
ctttggcccaccgtgttttc

SEQ ID NO: 8294 - DNA, 20 bp, Artificial Sequence
  Description of Artificial Sequence: Synthetic oligonucleotide
  Target: SOD1; (-) strand; PAM type: NRG; PAM sequence: TGG
tgttacctctcttcatcctt

SEQ ID NO: 8295 - DNA, 20 bp, Artificial Sequence
  Description of Artificial Sequence: Synthetic oligonucleotide
  Target: SOD1; (-) strand; PAM type: NRG; PAM sequence: AAG
tcgccattattacaagagtt

SEQ ID NO: 8296 - DNA, 20 bp, Artificial Sequence
  Description of Artificial Sequence: Synthetic oligonucleotide
  Target: SOD1; (-) strand; PAM type: NRG; PAM sequence: GAG
agctatcgccattattacaa

SEQ ID NO: 8297 - DNA, 20 bp, Artificial Sequence
  Description of Artificial Sequence: Synthetic oligonucleotide
  Target: SOD1; (-) strand; PAM type: NRG; PAM sequence: AAG
aaagctatcgccattattac

SEQ ID NO: 8298 - DNA, 20 bp, Artificial Sequence
  Description of Artificial Sequence: Synthetic oligonucleotide
  Target: SOD1; (-) strand; PAM type: NRG; PAM sequence: AAG
tataccatatgaactccaga

SEQ ID NO: 8299 - DNA, 20 bp, Artificial Sequence
  Description of Artificial Sequence: Synthetic oligonucleotide
  Target: SOD1; (-) strand; PAM type: NRG; PAM sequence: CAG
gtagtataccatatgaactc

SEQ ID NO: 8300 - DNA, 20 bp, Artificial Sequence
  Description of Artificial Sequence: Synthetic oligonucleotide
  Target: SOD1; (-) strand; PAM type: NRG; PAM sequence: TAG
tcttagcacatatttacaag

SEQ ID NO: 8301 - DNA, 20 bp, Artificial Sequence
  Description of Artificial Sequence: Synthetic oligonucleotide
  Target: SOD1; (-) strand; PAM type: NRG; PAM sequence: AAG
ttatcttagcacatatttac

SEQ ID NO: 8302 - DNA, 20 bp, Artificial Sequence
  Description of Artificial Sequence: Synthetic oligonucleotide
  Target: SOD1; (-) strand; PAM type: NRG; PAM sequence: TAG
ggggaaacacggaattatct

SEQ ID NO: 8303 - DNA, 20 bp, Artificial Sequence
  Description of Artificial Sequence: Synthetic oligonucleotide
  Target: SOD1; (-) strand; PAM type: NRG; PAM sequence: CGG
aagcaaaggtgggggaaaca

SEQ ID NO: 8304 - DNA, 20 bp, Artificial Sequence
  Description of Artificial Sequence: Synthetic oligonucleotide
  Target: SOD1; (-) strand; PAM type: NRG; PAM sequence: GGG
aagttcaaaagcaaaggtgg

SEQ ID NO: 8305 - DNA, 20 bp, Artificial Sequence
  Description of Artificial Sequence: Synthetic oligonucleotide
  Target: SOD1; (-) strand; PAM type: NRG; PAM sequence: GGG
caagttcaaaagcaaaggtg

SEQ ID NO: 8306 - DNA, 20 bp, Artificial Sequence
  Description of Artificial Sequence: Synthetic oligonucleotide
  Target: SOD1; (-) strand; PAM type: NRG; PAM sequence: GGG
gcaagttcaaaagcaaaggt

SEQ ID NO: 8307 - DNA, 20 bp, Artificial Sequence
  Description of Artificial Sequence: Synthetic oligonucleotide
  Target: SOD1; (-) strand; PAM type: NRG; PAM sequence: TGG
agcaagttcaaaagcaaagg

SEQ ID NO: 8308 - DNA, 20 bp, Artificial Sequence
  Description of Artificial Sequence: Synthetic oligonucleotide
  Target: SOD1; (-) strand; PAM type: NRG; PAM sequence: AGG
gtcagcaagttcaaaagcaa

SEQ ID NO: 8309 - DNA, 20 bp, Artificial Sequence
  Description of Artificial Sequence: Synthetic oligonucleotide
  Target: SOD1; (-) strand; PAM type: NRG; PAM sequence: AAG
agtcagcaagttcaaaagca

SEQ ID NO: 8310 - DNA, 20 bp, Artificial Sequence
  Description of Artificial Sequence: Synthetic oligonucleotide
  Target: SOD1; (-) strand; PAM type: NRG; PAM sequence: AAG
agatgagtcagcaagttcaa

SEQ ID NO: 8311 - DNA, 20 bp, Artificial Sequence
  Description of Artificial Sequence: Synthetic oligonucleotide
  Target: SOD1; (-) strand; PAM type: NRG; PAM sequence: AAG
aggggtttagatgagtcagc

SEQ ID NO: 8312 - DNA, 20 bp, Artificial Sequence
  Description of Artificial Sequence: Synthetic oligonucleotide
  Target: SOD1; (-) strand; PAM type: NRG; PAM sequence: CAG
gagcaggggtttagatgagt

SEQ ID NO: 8313 - DNA, 20 bp, Artificial Sequence
  Description of Artificial Sequence: Synthetic oligonucleotide
  Target: SOD1; (-) strand; PAM type: NRG; PAM sequence: GAG
ttgggagcaggggtttagat

SEQ ID NO: 8314 - DNA, 20 bp, Artificial Sequence
  Description of Artificial Sequence: Synthetic oligonucleotide
  Target: SOD1; (-) strand; PAM type: NRG; PAM sequence: TAG
agcatttgggagcaggggtt

SEQ ID NO: 8315 - DNA, 20 bp, Artificial Sequence
  Description of Artificial Sequence: Synthetic oligonucleotide
  Target: SOD1; (-) strand; PAM type: NRG; PAM sequence: GGG
attccagcatttgggagcag

SEQ ID NO: 8316 - DNA, 20 bp, Artificial Sequence
  Description of Artificial Sequence: Synthetic oligonucleotide
  Target: SOD1; (-) strand; PAM type: NRG; PAM sequence: GGG
cattccagcatttgggagca

SEQ ID NO: 8317 - DNA, 20 bp, Artificial Sequence
  Description of Artificial Sequence: Synthetic oligonucleotide
  Target: SOD1; (-) strand; PAM type: NRG; PAM sequence: AGG
gcattccagcatttgggagc

SEQ ID NO: 8318 - DNA, 20 bp, Artificial Sequence
  Description of Artificial Sequence: Synthetic oligonucleotide
  Target: SOD1; (-) strand; PAM type: NRG; PAM sequence: CAG
agcattccagcatttgggag

SEQ ID NO: 8319 - DNA, 20 bp, Artificial Sequence
  Description of Artificial Sequence: Synthetic oligonucleotide
  Target: SOD1; (-) strand; PAM type: NRG; PAM sequence: GAG
aaaagcattccagcatttgg

SEQ ID NO: 8320 - DNA, 20 bp, Artificial Sequence
  Description of Artificial Sequence: Synthetic oligonucleotide
  Target: SOD1; (-) strand; PAM type: NRG; PAM sequence: GGG
gtaaaagcattccagcattt

SEQ ID NO: 8321 - DNA, 20 bp, Artificial Sequence
  Description of Artificial Sequence: Synthetic oligonucleotide
  Target: SOD1; (-) strand; PAM type: NRG; PAM sequence: TGG
agtaaaagcattccagcatt

SEQ ID NO: 8322 - DNA, 20 bp, Artificial Sequence
  Description of Artificial Sequence: Synthetic oligonucleotide
  Target: SOD1; (-) strand; PAM type: NRG; PAM sequence: CAG
cccaggaagtaaaagcattc

SEQ ID NO: 8323 - DNA, 20 bp, Artificial Sequence
  Description of Artificial Sequence: Synthetic oligonucleotide
  Target: SOD1; (-) strand; PAM type: NRG; PAM sequence: AAG
cctttaagcccaggaagtaa

SEQ ID NO: 8324 - DNA, 20 bp, Artificial Sequence
  Description of Artificial Sequence: Synthetic oligonucleotide
  Target: SOD1; (-) strand; PAM type: NRG; PAM sequence: AAG
tcaattcctttaagcccagg

SEQ ID NO: 8325 - DNA, 20 bp, Artificial Sequence
  Description of Artificial Sequence: Synthetic oligonucleotide
  Target: SOD1; (-) strand; PAM type: NRG; PAM sequence: AGG
ttgtcaattcctttaagccc

SEQ ID NO: 8326 - DNA, 20 bp, Artificial Sequence
  Description of Artificial Sequence: Synthetic oligonucleotide
  Target: SOD1; (-) strand; PAM type: NRG; PAM sequence: CAG
tttgtcaattcctttaagcc

SEQ ID NO: 8327 - DNA, 20 bp, Artificial Sequence
  Description of Artificial Sequence: Synthetic oligonucleotide
  Target: SOD1; (-) strand; PAM type: NRG; PAM sequence: AAG
ccccatttgtcaattccttt

SEQ ID NO: 8328 - DNA, 20 bp, Artificial Sequence
  Description of Artificial Sequence: Synthetic oligonucleotide
  Target: SOD1; (-) strand; PAM type: NRG; PAM sequence: AAG
ctacaaaaccaaatcgtttt

SEQ ID NO: 8329 - DNA, 20 bp, Artificial Sequence
  Description of Artificial Sequence: Synthetic oligonucleotide
  Target: SOD1; (-) strand; PAM type: NRG; PAM sequence: TAG
ttcccctttggcacttgtat

SEQ ID NO: 8330 - DNA, 20 bp, Artificial Sequence
  Description of Artificial Sequence: Synthetic oligonucleotide
  Target: SOD1; (-) strand; PAM type: NRG; PAM sequence: TGG
ttcctgtattagttcccctt

SEQ ID NO: 8331 - DNA, 20 bp, Artificial Sequence
  Description of Artificial Sequence: Synthetic oligonucleotide
  Target: SOD1; (-) strand; PAM type: NRG; PAM sequence: TAG
gttcatgacatttcctgtat

SEQ ID NO: 8332 - DNA, 20 bp, Artificial Sequence
  Description of Artificial Sequence: Synthetic oligonucleotide
  Target: SOD1; (-) strand; PAM type: NRG; PAM sequence: CAG
ttgattttgctagtggttga

SEQ ID NO: 8333 - DNA, 20 bp, Artificial Sequence
  Description of Artificial Sequence: Synthetic oligonucleotide
  Target: SOD1; (-) strand; PAM type: NRG; PAM sequence: TGG
atgatgattgattttgctag

SEQ ID NO: 8334 - DNA, 20 bp, Artificial Sequence
  Description of Artificial Sequence: Synthetic oligonucleotide
  Target: SOD1; (-) strand; PAM type: NRG; PAM sequence: TAG
acaatgatgattgattttgc

SEQ ID NO: 8335 - DNA, 20 bp, Artificial Sequence
  Description of Artificial Sequence: Synthetic oligonucleotide
  Target: SOD1; (-) strand; PAM type: NRG; PAM sequence: AAG
atttttttttttatctacag

SEQ ID NO: 8336 - DNA, 20 bp, Artificial Sequence
  Description of Artificial Sequence: Synthetic oligonucleotide
  Target: SOD1; (-) strand; PAM type: NRG; PAM sequence: CAG
tcaatttttttttttatcta

SEQ ID NO: 8337 - DNA, 20 bp, Artificial Sequence
  Description of Artificial Sequence: Synthetic oligonucleotide
  Target: SOD1; (-) strand; PAM type: NRG; PAM sequence: CAG
atggagtctcgactagtttt

SEQ ID NO: 8338 - DNA, 20 bp, Artificial Sequence
  Description of Artificial Sequence: Synthetic oligonucleotide
  Target: SOD1; (-) strand; PAM type: NRG; PAM sequence: TAG
catataaatggagtctcgac

SEQ ID NO: 8339 - DNA, 20 bp, Artificial Sequence
  Description of Artificial Sequence: Synthetic oligonucleotide
  Target: SOD1; (-) strand; PAM type: NRG; PAM sequence: GAG
aaaacatacacatataaatg

SEQ ID NO: 8340 - DNA, 20 bp, Artificial Sequence
  Description of Artificial Sequence: Synthetic oligonucleotide
  Target: SOD1; (-) strand; PAM type: NRG; PAM sequence: TGG
agaaaacatacacatataaa

SEQ ID NO: 8341 - DNA, 20 bp, Artificial Sequence
  Description of Artificial Sequence: Synthetic oligonucleotide
  Target: SOD1; (-) strand; PAM type: NRG; PAM sequence: CAG
atatttttctgaaaggcttt

SEQ ID NO: 8342 - DNA, 20 bp, Artificial Sequence
  Description of Artificial Sequence: Synthetic oligonucleotide
  Target: SOD1; (-) strand; PAM type: NRG; PAM sequence: AGG
aaatttaatatttttctgaa

SEQ ID NO: 8343 - DNA, 20 bp, Artificial Sequence
  Description of Artificial Sequence: Synthetic oligonucleotide
  Target: SOD1; (-) strand; PAM type: NRG; PAM sequence: AAG
taaatttaatatttttctga

SEQ ID NO: 8344 - DNA, 20 bp, Artificial Sequence
  Description of Artificial Sequence: Synthetic oligonucleotide
  Target: SOD1; (-) strand; PAM type: NRG; PAM sequence: AGG
gctaacaaagctatgtccca

SEQ ID NO: 8345 - DNA, 20 bp, Artificial Sequence
  Description of Artificial Sequence: Synthetic oligonucleotide
  Target: SOD1; (-) strand; PAM type: NRG; PAM sequence: AAG
agctaacaaagctatgtccc

SEQ ID NO: 8346 - DNA, 20 bp, Artificial Sequence
  Description of Artificial Sequence: Synthetic oligonucleotide
  Target: SOD1; (-) strand; PAM type: NRG; PAM sequence: AAG
aattactggcatagctaaca

SEQ ID NO: 8347 - DNA, 20 bp, Artificial Sequence
  Description of Artificial Sequence: Synthetic oligonucleotide
  Target: SOD1; (-) strand; PAM type: NRG; PAM sequence: TAG
atgcctgttaattactggca

SEQ ID NO: 8348 - DNA, 20 bp, Artificial Sequence
  Description of Artificial Sequence: Synthetic oligonucleotide
  Target: SOD1; (-) strand; PAM type: NRG; PAM sequence: TGG
gagttatgcctgttaattac

SEQ ID NO: 8349 - DNA, 20 bp, Artificial Sequence
  Description of Artificial Sequence: Synthetic oligonucleotide
  Target: SOD1; (-) strand; PAM type: NRG; PAM sequence: GAG
agggtaaactctcagttact

SEQ ID NO: 8350 - DNA, 20 bp, Artificial Sequence
  Description of Artificial Sequence: Synthetic oligonucleotide
  Target: SOD1; (-) strand; PAM type: NRG; PAM sequence: CAG
agtaccaaagggtaaactct

SEQ ID NO: 8351 - DNA, 20 bp, Artificial Sequence
  Description of Artificial Sequence: Synthetic oligonucleotide
  Target: SOD1; (-) strand; PAM type: NRG; PAM sequence: GGG
ctgatttcagaagtaccaaa

SEQ ID NO: 8352 - DNA, 20 bp, Artificial Sequence
  Description of Artificial Sequence: Synthetic oligonucleotide
  Target: SOD1; (-) strand; PAM type: NRG; PAM sequence: AGG
cctgatttcagaagtaccaa

SEQ ID NO: 8353 - DNA, 20 bp, Artificial Sequence
  Description of Artificial Sequence: Synthetic oligonucleotide
  Target: SOD1; (-) strand; PAM type: NRG; PAM sequence: AAG
acctgatttcagaagtacca

SEQ ID NO: 8354 - DNA, 20 bp, Artificial Sequence
  Description of Artificial Sequence: Synthetic oligonucleotide
  Target: SOD1; (-) strand; PAM type: NRG; PAM sequence: AAG
ggggctgcacctgatttcag

SEQ ID NO: 8355 - DNA, 20 bp, Artificial Sequence
  Description of Artificial Sequence: Synthetic oligonucleotide
  Target: SOD1; (-) strand; PAM type: NRG; PAM sequence: CAG
gatggggctgcacctgattt

SEQ ID NO: 8356 - DNA, 20 bp, Artificial Sequence
  Description of Artificial Sequence: Synthetic oligonucleotide
  Target: SOD1; (-) strand; PAM type: NRG; PAM sequence: GGG
atgctctgggaagaaagatg

SEQ ID NO: 8357 - DNA, 20 bp, Artificial Sequence
  Description of Artificial Sequence: Synthetic oligonucleotide
  Target: SOD1; (-) strand; PAM type: NRG; PAM sequence: GGG
aatgctctgggaagaaagat

SEQ ID NO: 8358 - DNA, 20 bp, Artificial Sequence
  Description of Artificial Sequence: Synthetic oligonucleotide
  Target: SOD1; (-) strand; PAM type: NRG; PAM sequence: TGG
taatgctctgggaagaaaga

SEQ ID NO: 8359 - DNA, 20 bp, Artificial Sequence
  Description of Artificial Sequence: Synthetic oligonucleotide
  Target: SOD1; (-) strand; PAM type: NRG; PAM sequence: AAG
acactaatgctctgggaaga

SEQ ID NO: 8360 - DNA, 20 bp, Artificial Sequence
  Description of Artificial Sequence: Synthetic oligonucleotide
  Target: SOD1; (-) strand; PAM type: NRG; PAM sequence: AAG
ctacacactaatgctctggg

SEQ ID NO: 8361 - DNA, 20 bp, Artificial Sequence
  Description of Artificial Sequence: Synthetic oligonucleotide
  Target: SOD1; (-) strand; PAM type: NRG; PAM sequence: GGG
cgtctacacactaatgctct

SEQ ID NO: 8362 - DNA, 20 bp, Artificial Sequence
  Description of Artificial Sequence: Synthetic oligonucleotide
  Target: SOD1; (-) strand; PAM type: NRG; PAM sequence: TGG
acgtctacacactaatgctc

SEQ ID NO: 8363 - DNA, 20 bp, Artificial Sequence
  Description of Artificial Sequence: Synthetic oligonucleotide
  Target: SOD1; (-) strand; PAM type: NRG; PAM sequence: AGG
taaatacagctcttcaaaca

SEQ ID NO: 8364 - DNA, 20 bp, Artificial Sequence
  Description of Artificial Sequence: Synthetic oligonucleotide
  Target: SOD1; (-) strand; PAM type: NRG; PAM sequence: AAG
ctaaatacagctcttcaaac

SEQ ID NO: 8365 - DNA, 20 bp, Artificial Sequence
  Description of Artificial Sequence: Synthetic oligonucleotide
  Target: SOD1; (-) strand; PAM type: NRG; PAM sequence: CAG
gtagctaggcattctaaata

SEQ ID NO: 8366 - DNA, 20 bp, Artificial Sequence
  Description of Artificial Sequence: Synthetic oligonucleotide
  Target: SOD1; (-) strand; PAM type: NRG; PAM sequence: AGG
aaatttgcaaacaagtagct

SEQ ID NO: 8367 - DNA, 20 bp, Artificial Sequence
  Description of Artificial Sequence: Synthetic oligonucleotide
  Target: SOD1; (-) strand; PAM type: NRG; PAM sequence: TAG
caaatttgcaaacaagtagc

SEQ ID NO: 8368 - DNA, 20 bp, Artificial Sequence
  Description of Artificial Sequence: Synthetic oligonucleotide
  Target: SOD1; (-) strand; PAM type: NRG; PAM sequence: TAG
gacacaaatttgcaaacaag

SEQ ID NO: 8369 - DNA, 20 bp, Artificial Sequence
  Description of Artificial Sequence: Synthetic oligonucleotide
  Target: SOD1; (-) strand; PAM type: NRG; PAM sequence: AAG
gtagacacaaatttgcaaac

SEQ ID NO: 8370 - DNA, 20 bp, Artificial Sequence
  Description of Artificial Sequence: Synthetic oligonucleotide
  Target: SOD1; (-) strand; PAM type: NRG; PAM sequence: TAG
taaattaaaacttgactgag

SEQ ID NO: 8371 - DNA, 20 bp, Artificial Sequence
  Description of Artificial Sequence: Synthetic oligonucleotide
  Target: SOD1; (-) strand; PAM type: NRG; PAM sequence: GAG
agctaaattaaaacttgact

SEQ ID NO: 8372 - DNA, 20 bp, Artificial Sequence
  Description of Artificial Sequence: Synthetic oligonucleotide
  Target: SOD1; (-) strand; PAM type: NRG; PAM sequence: GAG
taaacatcaaggtagttcat

SEQ ID NO: 8373 - DNA, 20 bp, Artificial Sequence
  Description of Artificial Sequence: Synthetic oligonucleotide
  Target: SOD1; (-) strand; PAM type: NRG; PAM sequence: TAG
gatgccactaaacatcaagg

SEQ ID NO: 8374 - DNA, 20 bp, Artificial Sequence
  Description of Artificial Sequence: Synthetic oligonucleotide
  Target: SOD1; (-) strand; PAM type: NRG; PAM sequence: AGG
gctgatgccactaaacatca

SEQ ID NO: 8375 - DNA, 20 bp, Artificial Sequence
  Description of Artificial Sequence: Synthetic oligonucleotide
  Target: SOD1; (-) strand; PAM type: NRG; PAM sequence: AAG
ggctgatgccactaaacatc

SEQ ID NO: 8376 - DNA, 20 bp, Artificial Sequence
  Description of Artificial Sequence: Synthetic oligonucleotide
  Target: SOD1; (-) strand; PAM type: NRG; PAM sequence: GGG
aaaaagcatcagatggatta

SEQ ID NO: 8377 - DNA, 20 bp, Artificial Sequence
  Description of Artificial Sequence: Synthetic oligonucleotide
  Target: SOD1; (-) strand; PAM type: NRG; PAM sequence: AGG
gaaaaagcatcagatggatt

SEQ ID NO: 8378 - DNA, 20 bp, Artificial Sequence
  Description of Artificial Sequence: Synthetic oligonucleotide
  Target: SOD1; (-) strand; PAM type: NRG; PAM sequence: TAG
tgaaaaagcatcagatggat

SEQ ID NO: 8379 - DNA, 20 bp, Artificial Sequence
  Description of Artificial Sequence: Synthetic oligonucleotide
  Target: SOD1; (-) strand; PAM type: NRG; PAM sequence: TGG
aataatgaaaaagcatcaga

SEQ ID NO: 8380 - DNA, 20 bp, Artificial Sequence
  Description of Artificial Sequence: Synthetic oligonucleotide
  Target: SOD1; (-) strand; PAM type: NRG; PAM sequence: CAG
gcctaataatgaaaaagcat

SEQ ID NO: 8381 - DNA, 20 bp, Artificial Sequence
  Description of Artificial Sequence: Synthetic oligonucleotide
  Target: SOD1; (-) strand; PAM type: NRG; PAM sequence: AAG
caacatgcctaataatgaaa

SEQ ID NO: 8382 - DNA, 20 bp, Artificial Sequence
  Description of Artificial Sequence: Synthetic oligonucleotide
  Target: SOD1; (-) strand; PAM type: NRG; PAM sequence: AAG
tgtcagcagtcacattgccc

SEQ ID NO: 8383 - DNA, 20 bp, Artificial Sequence
  Description of Artificial Sequence: Synthetic oligonucleotide
  Target: SOD1; (-) strand; PAM type: NRG; PAM sequence: CAG
ggccacaccatctttgtcag

SEQ ID NO: 8384 - DNA, 20 bp, Artificial Sequence
  Description of Artificial Sequence: Synthetic oligonucleotide
  Target: SOD1; (-) strand; PAM type: NRG; PAM sequence: CAG
atcggccacaccatctttgt

SEQ ID NO: 8385 - DNA, 20 bp, Artificial Sequence
  Description of Artificial Sequence: Synthetic oligonucleotide
  Target: SOD1; (-) strand; PAM type: NRG; PAM sequence: CGG
agaatcttcaatagacacat

SEQ ID NO: 8386 - DNA, 20 bp, Artificial Sequence
  Description of Artificial Sequence: Synthetic oligonucleotide
  Target: SOD1; (-) strand; PAM type: NRG; PAM sequence: TAG
tgagatcacagaatcttcaa

SEQ ID NO: 8387 - DNA, 20 bp, Artificial Sequence
  Description of Artificial Sequence: Synthetic oligonucleotide
  Target: SOD1; (-) strand; PAM type: NRG; PAM sequence: CAG
gtctcctgagagtgagatca

SEQ ID NO: 8388 - DNA, 20 bp, Artificial Sequence
  Description of Artificial Sequence: Synthetic oligonucleotide
  Target: SOD1; (-) strand; PAM type: NRG; PAM sequence: GAG
tgcaatggtctcctgagagt

SEQ ID NO: 8389 - DNA, 20 bp, Artificial Sequence
  Description of Artificial Sequence: Synthetic oligonucleotide
  Target: SOD1; (-) strand; PAM type: NRG; PAM sequence: GAG
atgatgcaatggtctcctga

SEQ ID NO: 8390 - DNA, 20 bp, Artificial Sequence
  Description of Artificial Sequence: Synthetic oligonucleotide
  Target: SOD1; (-) strand; PAM type: NRG; PAM sequence: GAG
caatgatgcaatggtctcct

SEQ ID NO: 8391 - DNA, 20 bp, Artificial Sequence
  Description of Artificial Sequence: Synthetic oligonucleotide
  Target: SOD1; (-) strand; PAM type: NRG; PAM sequence: TGG
gtgtgcggccaatgatgcaa

SEQ ID NO: 8392 - DNA, 20 bp, Artificial Sequence
  Description of Artificial Sequence: Synthetic oligonucleotide
  Target: SOD1; (-) strand; PAM type: NRG; PAM sequence: CGG
gaaaacttaccaccagtgtg

SEQ ID NO: 8393 - DNA, 20 bp, Artificial Sequence
  Description of Artificial Sequence: Synthetic oligonucleotide
  Target: SOD1; (-) strand; PAM type: NRG; PAM sequence: CAG
cttttatgaaaacttaccac

SEQ ID NO: 8394 - DNA, 20 bp, Artificial Sequence
  Description of Artificial Sequence: Synthetic oligonucleotide
  Target: SOD1; (-) strand; PAM type: NRG; PAM sequence: AAG
acatgactgtatgttagaag

SEQ ID NO: 8395 - DNA, 20 bp, Artificial Sequence
  Description of Artificial Sequence: Synthetic oligonucleotide
  Target: SOD1; (-) strand; PAM type: NRG; PAM sequence: AAG
gatacatgactgtatgttag

SEQ ID NO: 8396 - DNA, 20 bp, Artificial Sequence
  Description of Artificial Sequence: Synthetic oligonucleotide
  Target: SOD1; (-) strand; PAM type: NRG; PAM sequence: TAG
aaagatacatgactgtatgt

SEQ ID NO: 8397 - DNA, 20 bp, Artificial Sequence
  Description of Artificial Sequence: Synthetic oligonucleotide
  Target: SOD1; (-) strand; PAM type: NRG; PAM sequence: AAG
cgactaacaatcaaagtgaa

SEQ ID NO: 8398 - DNA, 20 bp, Artificial Sequence
  Description of Artificial Sequence: Synthetic oligonucleotide
  Target: SOD1; (-) strand; PAM type: NRG; PAM sequence: AAG
gaaaccgcgactaacaatca

SEQ ID NO: 8399 - DNA, 20 bp, Artificial Sequence
  Description of Artificial Sequence: Synthetic oligonucleotide
  Target: SOD1; (-) strand; PAM type: NRG; PAM sequence: TAG
gtacagtttatctggatctt

SEQ ID NO: 8400 - DNA, 20 bp, Artificial Sequence
  Description of Artificial Sequence: Synthetic oligonucleotide
  Target: SOD1; (-) strand; PAM type: NRG; PAM sequence: TGG
aactgcaagtacagtttatc

SEQ ID NO: 8401 - DNA, 20 bp, Artificial Sequence
  Description of Artificial Sequence: Synthetic oligonucleotide
  Target: SOD1; (-) strand; PAM type: NRG; PAM sequence: CAG
cctaatttgaactgcaagta

SEQ ID NO: 8402 - DNA, 20 bp, Artificial Sequence
  Description of Artificial Sequence: Synthetic oligonucleotide
  Target: SOD1; (-) strand; PAM type: NRG; PAM sequence: AAG
cttttcctaatttgaactgc

SEQ ID NO: 8403 - DNA, 20 bp, Artificial Sequence
  Description of Artificial Sequence: Synthetic oligonucleotide
  Target: SOD1; (-) strand; PAM type: NRG; PAM sequence: TAG
aacagtgttcttaactgacc

SEQ ID NO: 8404 - DNA, 20 bp, Artificial Sequence
  Description of Artificial Sequence: Synthetic oligonucleotide
  Target: SOD1; (-) strand; PAM type: NRG; PAM sequence: CAG
tttactgcatcttagcagaa

SEQ ID NO: 8405 - DNA, 20 bp, Artificial Sequence
  Description of Artificial Sequence: Synthetic oligonucleotide
  Target: SOD1; (-) strand; PAM type: NRG; PAM sequence: CAG
tgctttttactgcatcttag

SEQ ID NO: 8406 - DNA, 20 bp, Artificial Sequence
  Description of Artificial Sequence: Synthetic oligonucleotide
  Target: SOD1; (-) strand; PAM type: NRG; PAM sequence: TAG
acctgctttttactgcatct

SEQ ID NO: 8407 - DNA, 20 bp, Artificial Sequence
  Description of Artificial Sequence: Synthetic oligonucleotide
  Target: SOD1; (-) strand; PAM type: NRG; PAM sequence: TGG
ttccaaactcagatctaata

SEQ ID NO: 8408 - DNA, 20 bp, Artificial Sequence
  Description of Artificial Sequence: Synthetic oligonucleotide
  Target: SOD1; (-) strand; PAM type: NRG; PAM sequence: CAG
ctacttctgttttccaaact

SEQ ID NO: 8409 - DNA, 20 bp, Artificial Sequence
  Description of Artificial Sequence: Synthetic oligonucleotide
  Target: SOD1; (-) strand; PAM type: NRG; PAM sequence: AAG
atctggccattttaaaacta

SEQ ID NO: 8410 - DNA, 20 bp, Artificial Sequence
  Description of Artificial Sequence: Synthetic oligonucleotide
  Target: SOD1; (-) strand; PAM type: NRG; PAM sequence: TGG
ccaatcctggcaagaaaatc

SEQ ID NO: 8411 - DNA, 20 bp, Artificial Sequence
  Description of Artificial Sequence: Synthetic oligonucleotide
  Target: SOD1; (-) strand; PAM type: NRG; PAM sequence: AAG
gtgagaaacccaatcctggc

SEQ ID NO: 8412 - DNA, 20 bp, Artificial Sequence
  Description of Artificial Sequence: Synthetic oligonucleotide
  Target: SOD1; (-) strand; PAM type: NRG; PAM sequence: TGG
acaagtgagaaacccaatcc

SEQ ID NO: 8413 - DNA, 20 bp, Artificial Sequence
  Description of Artificial Sequence: Synthetic oligonucleotide
  Target: SOD1; (-) strand; PAM type: NRG; PAM sequence: GAG
aaatgttctgtttaacaagt

SEQ ID NO: 8414 - DNA, 20 bp, Artificial Sequence
  Description of Artificial Sequence: Synthetic oligonucleotide
  Target: SOD1; (-) strand; PAM type: NRG; PAM sequence: AAG
aacaaaatgttctgtttaac

SEQ ID NO: 8415 - DNA, 20 bp, Artificial Sequence
  Description of Artificial Sequence: Synthetic oligonucleotide
  Target: SOD1; (-) strand; PAM type: NRG; PAM sequence: AGG
tgaatacttaagtccatccc

SEQ ID NO: 8416 - DNA, 20 bp, Artificial Sequence
  Description of Artificial Sequence: Synthetic oligonucleotide
  Target: SOD1; (-) strand; PAM type: NRG; PAM sequence: CAG
atgaatacttaagtccatcc

SEQ ID NO: 8417 - DNA, 20 bp, Artificial Sequence
  Description of Artificial Sequence: Synthetic oligonucleotide
  Target: SOD1; (-) strand; PAM type: NRG; PAM sequence: AAG
atgaatgaacatgaatactt

SEQ ID NO: 8418 - DNA, 20 bp, Artificial Sequence
  Description of Artificial Sequence: Synthetic oligonucleotide
  Target: SOD1; (-) strand; PAM type: NRG; PAM sequence: CAG
aaacaagtcatgataacctg

SEQ ID NO: 8419 - DNA, 20 bp, Artificial Sequence
  Description of Artificial Sequence: Synthetic oligonucleotide
  Target: SOD1; (-) strand; PAM type: NRG; PAM sequence: AAG
cagcttcccacaagttaaac

SEQ ID NO: 8420 - DNA, 20 bp, Artificial Sequence
  Description of Artificial Sequence: Synthetic oligonucleotide
  Target: SOD1; (-) strand; PAM type: NRG; PAM sequence: AAG
ttgggacaacagcttcccac

SEQ ID NO: 8421 - DNA, 20 bp, Artificial Sequence
  Description of Artificial Sequence: Synthetic oligonucleotide
  Target: SOD1; (-) strand; PAM type: NRG; PAM sequence: CAG
cccaggataacttgggacaa

SEQ ID NO: 8422 - DNA, 20 bp, Artificial Sequence
  Description of Artificial Sequence: Synthetic oligonucleotide
  Target: SOD1; (-) strand; PAM type: NRG; PAM sequence: GGG
gcagttccccaggataactt

SEQ ID NO: 8423 - DNA, 20 bp, Artificial Sequence
  Description of Artificial Sequence: Synthetic oligonucleotide
  Target: SOD1; (-) strand; PAM type: NRG; PAM sequence: TGG
tgcagttccccaggataact

SEQ ID NO: 8424 - DNA, 20 bp, Artificial Sequence
  Description of Artificial Sequence: Synthetic oligonucleotide
  Target: SOD1; (-) strand; PAM type: NRG; PAM sequence: AGG
agaaccagatgcagttcccc

SEQ ID NO: 8425 - DNA, 20 bp, Artificial Sequence
  Description of Artificial Sequence: Synthetic oligonucleotide
  Target: SOD1; (-) strand; PAM type: NRG; PAM sequence: CAG
aagaaccagatgcagttccc

SEQ ID NO: 8426 - DNA, 20 bp, Artificial Sequence
  Description of Artificial Sequence: Synthetic oligonucleotide
  Target: SOD1; (-) strand; PAM type: NRG; PAM sequence: CAG
tgttttgcaagaaccagatg

SEQ ID NO: 8427 - DNA, 20 bp, Artificial Sequence
  Description of Artificial Sequence: Synthetic oligonucleotide
  Target: SOD1; (-) strand; PAM type: NRG; PAM sequence: CAG
acttggtgttttgcaagaac

SEQ ID NO: 8428 - DNA, 20 bp, Artificial Sequence
  Description of Artificial Sequence: Synthetic oligonucleotide
  Target: SOD1; (-) strand; PAM type: NRG; PAM sequence: AAG
ctgtctacttggtgttttgc

SEQ ID NO: 8429 - DNA, 20 bp, Artificial Sequence
  Description of Artificial Sequence: Synthetic oligonucleotide
  Target: SOD1; (-) strand; PAM type: NRG; PAM sequence: TGG
taaaagagagcctgtctact

SEQ ID NO: 8430 - DNA, 20 bp, Artificial Sequence
  Description of Artificial Sequence: Synthetic oligonucleotide
  Target: SOD1; (-) strand; PAM type: NRG; PAM sequence: GAG
cctcaaggggaggtaaaaga

SEQ ID NO: 8431 - DNA, 20 bp, Artificial Sequence
  Description of Artificial Sequence: Synthetic oligonucleotide
  Target: SOD1; (-) strand; PAM type: NRG; PAM sequence: GAG
gccctcaaggggaggtaaaa

SEQ ID NO: 8432 - DNA, 20 bp, Artificial Sequence
  Description of Artificial Sequence: Synthetic oligonucleotide
  Target: SOD1; (-) strand; PAM type: NRG; PAM sequence: AAG
atgccctcaaggggaggtaa

SEQ ID NO: 8433 - DNA, 20 bp, Artificial Sequence
  Description of Artificial Sequence: Synthetic oligonucleotide
  Target: SOD1; (-) strand; PAM type: NRG; PAM sequence: AGG
atgttaatgccctcaagggg

SEQ ID NO: 8434 - DNA, 20 bp, Artificial Sequence
  Description of Artificial Sequence: Synthetic oligonucleotide
  Target: SOD1; (-) strand; PAM type: NRG; PAM sequence: GAG
aatgttaatgccctcaaggg

SEQ ID NO: 8435 - DNA, 20 bp, Artificial Sequence
  Description of Artificial Sequence: Synthetic oligonucleotide
  Target: SOD1; (-) strand; PAM type: NRG; PAM sequence: GGG
tgaatgttaatgccctcaag

SEQ ID NO: 8436 - DNA, 20 bp, Artificial Sequence
  Description of Artificial Sequence: Synthetic oligonucleotide
  Target: SOD1; (-) strand; PAM type: NRG; PAM sequence: GGG
ctgaatgttaatgccctcaa

SEQ ID NO: 8437 - DNA, 20 bp, Artificial Sequence
  Description of Artificial Sequence: Synthetic oligonucleotide
  Target: SOD1; (-) strand; PAM type: NRG; PAM sequence: AGG
actgaatgttaatgccctca

SEQ ID NO: 8438 - DNA, 20 bp, Artificial Sequence
  Description of Artificial Sequence: Synthetic oligonucleotide
  Target: SOD1; (-) strand; PAM type: NRG; PAM sequence: AAG
tactgaatgttaatgccctc

SEQ ID NO: 8439 - DNA, 20 bp, Artificial Sequence
  Description of Artificial Sequence: Synthetic oligonucleotide
  Target: SOD1; (-) strand; PAM type: NRG; PAM sequence: AAG
ataaagggttaactgaatgg

SEQ ID NO: 8440 - DNA, 20 bp, Artificial Sequence
  Description of Artificial Sequence: Synthetic oligonucleotide
  Target: SOD1; (-) strand; PAM type: NRG; PAM sequence: TGG
aaaataaagggttaactgaa

SEQ ID NO: 8441 - DNA, 20 bp, Artificial Sequence
  Description of Artificial Sequence: Synthetic oligonucleotide
  Target: SOD1; (-) strand; PAM type: NRG; PAM sequence: GGG
agaaaaaccataaaaataaa

SEQ ID NO: 8442 - DNA, 20 bp, Artificial Sequence
  Description of Artificial Sequence: Synthetic oligonucleotide
  Target: SOD1; (-) strand; PAM type: NRG; PAM sequence: AGG
aagaaaaaccataaaaataa

SEQ ID NO: 8443 - DNA, 20 bp, Artificial Sequence
  Description of Artificial Sequence: Synthetic oligonucleotide
  Target: SOD1; (-) strand; PAM type: NRG; PAM sequence: AAG
caagaaaaaccataaaaata

SEQ ID NO: 8444 - DNA, 20 bp, Artificial Sequence
  Description of Artificial Sequence: Synthetic oligonucleotide
  Target: SOD1; (-) strand; PAM type: NRG; PAM sequence: AAG
ctgctttacaactatggctc

SEQ ID NO: 8445 - DNA, 20 bp, Artificial Sequence
  Description of Artificial Sequence: Synthetic oligonucleotide
  Target: SOD1; (-) strand; PAM type: NRG; PAM sequence: TGG
atttttctgctttacaacta

SEQ ID NO: 8446 - DNA, 20 bp, Artificial Sequence
  Description of Artificial Sequence: Synthetic oligonucleotide
  Target: SOD1; (-) strand; PAM type: NRG; PAM sequence: CAG
aatcttaatactttaagcaa

SEQ ID NO: 8447 - DNA, 20 bp, Artificial Sequence
  Description of Artificial Sequence: Synthetic oligonucleotide
  Target: SOD1; (-) strand; PAM type: NRG; PAM sequence: AAG
ctaaaaaatcttaatacttt

SEQ ID NO: 8448 - DNA, 20 bp, Artificial Sequence
  Description of Artificial Sequence: Synthetic oligonucleotide
  Target: SOD1; (-) strand; PAM type: NRG; PAM sequence: AGG
gaatgacgggcctataagta

SEQ ID NO: 8449 - DNA, 20 bp, Artificial Sequence
  Description of Artificial Sequence: Synthetic oligonucleotide
  Target: SOD1; (-) strand; PAM type: NRG; PAM sequence: AAG
tgaatgacgggcctataagt

SEQ ID NO: 8450 - DNA, 20 bp, Artificial Sequence
  Description of Artificial Sequence: Synthetic oligonucleotide
  Target: SOD1; (-) strand; PAM type: NRG; PAM sequence: AAG
caaatgaatgacgggcctat

SEQ ID NO: 8451 - DNA, 20 bp, Artificial Sequence
  Description of Artificial Sequence: Synthetic oligonucleotide
  Target: SOD1; (-) strand; PAM type: NRG; PAM sequence: GGG
tttcatgccaaatgaatgac

SEQ ID NO: 8452 - DNA, 20 bp, Artificial Sequence
  Description of Artificial Sequence: Synthetic oligonucleotide
  Target: SOD1; (-) strand; PAM type: NRG; PAM sequence: CGG
atttcatgccaaatgaatga

SEQ ID NO: 8453 - DNA, 20 bp, Artificial Sequence
  Description of Artificial Sequence: Synthetic oligonucleotide
  Target: SOD1; (-) strand; PAM type: NRG; PAM sequence: AAG
ttggaaaaaaaggaaagtga

SEQ ID NO: 8454 - DNA, 20 bp, Artificial Sequence
  Description of Artificial Sequence: Synthetic oligonucleotide
  Target: SOD1; (-) strand; PAM type: NRG; PAM sequence: AAG
attgctttggaaaaaaagga

SEQ ID NO: 8455 - DNA, 20 bp, Artificial Sequence
  Description of Artificial Sequence: Synthetic oligonucleotide
  Target: SOD1; (-) strand; PAM type: NRG; PAM sequence: AGG
tttaattgctttggaaaaaa

SEQ ID NO: 8456 - DNA, 20 bp, Artificial Sequence
  Description of Artificial Sequence: Synthetic oligonucleotide
  Target: SOD1; (-) strand; PAM type: NRG; PAM sequence: AAG
ttttaattgctttggaaaaa

SEQ ID NO: 8457 - DNA, 20 bp, Artificial Sequence
  Description of Artificial Sequence: Synthetic oligonucleotide
  Target: SOD1; (-) strand; PAM type: NRG; PAM sequence: TGG
ggcagtttttttaattgctt

SEQ ID NO: 8458 - DNA, 20 bp, Artificial Sequence
  Description of Artificial Sequence: Synthetic oligonucleotide
  Target: SOD1; (-) strand; PAM type: NRG; PAM sequence: CAG
cgcagtcactcttactttgg

SEQ ID NO: 8459 - DNA, 20 bp, Artificial Sequence
  Description of Artificial Sequence: Synthetic oligonucleotide
  Target: SOD1; (-) strand; PAM type: NRG; PAM sequence: TGG
ttccgcagtcactcttactt

SEQ ID NO: 8460 - DNA, 20 bp, Artificial Sequence
  Description of Artificial Sequence: Synthetic oligonucleotide
  Target: SOD1; (-) strand; PAM type: NRG; PAM sequence: CAG
ttacagtaaccttagttccg

SEQ ID NO: 8461 - DNA, 20 bp, Artificial Sequence
  Description of Artificial Sequence: Synthetic oligonucleotide
  Target: SOD1; (-) strand; PAM type: NRG; PAM sequence: TAG
atggtaagttacagtaacct

SEQ ID NO: 8462 - DNA, 20 bp, Artificial Sequence
  Description of Artificial Sequence: Synthetic oligonucleotide
  Target: SOD1; (-) strand; PAM type: NRG; PAM sequence: CAG
taatcctccatggtaagtta

SEQ ID NO: 8463 - DNA, 20 bp, Artificial Sequence
  Description of Artificial Sequence: Synthetic oligonucleotide
  Target: SOD1; (-) strand; PAM type: NRG; PAM sequence: AAG
tacccttaatcctccatggt

SEQ ID NO: 8464 - DNA, 20 bp, Artificial Sequence
  Description of Artificial Sequence: Synthetic oligonucleotide
  Target: SOD1; (-) strand; PAM type: NRG; PAM sequence: TGG
acgctacccttaatcctcca

SEQ ID NO: 8465 - DNA, 20 bp, Artificial Sequence
  Description of Artificial Sequence: Synthetic oligonucleotide
  Target: SOD1; (-) strand; PAM type: NRG; PAM sequence: TAG
aaacccaaataactatgttg

SEQ ID NO: 8466 - DNA, 20 bp, Artificial Sequence
  Description of Artificial Sequence: Synthetic oligonucleotide
  Target: SOD1; (-) strand; PAM type: NRG; PAM sequence: AAG
attacctttaaacattaggt

SEQ ID NO: 8467 - DNA, 20 bp, Artificial Sequence
  Description of Artificial Sequence: Synthetic oligonucleotide
  Target: SOD1; (-) strand; PAM type: NRG; PAM sequence: AGG
agacattacctttaaacatt

SEQ ID NO: 8468 - DNA, 20 bp, Artificial Sequence
  Description of Artificial Sequence: Synthetic oligonucleotide
  Target: SOD1; (-) strand; PAM type: NRG; PAM sequence: TAG
aagacattacctttaaacat

SEQ ID NO: 8469 - DNA, 20 bp, Artificial Sequence
  Description of Artificial Sequence: Synthetic oligonucleotide
  Target: SOD1; (-) strand; PAM type: NRG; PAM sequence: AAG
agctttttcttggtgttgca

SEQ ID NO: 8470 - DNA, 20 bp, Artificial Sequence
  Description of Artificial Sequence: Synthetic oligonucleotide
  Target: SOD1; (-) strand; PAM type: NRG; PAM sequence: TGG
tactactcaaagctttttct

SEQ ID NO: 8471 - DNA, 20 bp, Artificial Sequence
  Description of Artificial Sequence: Synthetic oligonucleotide
  Target: SOD1; (-) strand; PAM type: NRG; PAM sequence: AAG
aaagtagaaactactactca

SEQ ID NO: 8472 - DNA, 20 bp, Artificial Sequence
  Description of Artificial Sequence: Synthetic oligonucleotide
  Target: SOD1; (-) strand; PAM type: NRG; PAM sequence: TAG
aatatttagtagtttaaaag

SEQ ID NO: 8473 - DNA, 20 bp, Artificial Sequence
  Description of Artificial Sequence: Synthetic oligonucleotide
  Target: SOD1; (-) strand; PAM type: NRG; PAM sequence: AAG
actaatatttagtagtttaa

SEQ ID NO: 8474 - DNA, 20 bp, Artificial Sequence
  Description of Artificial Sequence: Synthetic oligonucleotide
  Target: SOD1; (-) strand; PAM type: NRG; PAM sequence: TAG
agagatatactaatatttag

SEQ ID NO: 8475 - DNA, 20 bp, Artificial Sequence
  Description of Artificial Sequence: Synthetic oligonucleotide
  Target: SOD1; (-) strand; PAM type: NRG; PAM sequence: TAG
tagagagatatactaatatt

SEQ ID NO: 8476 - DNA, 20 bp, Artificial Sequence
  Description of Artificial Sequence: Synthetic oligonucleotide
  Target: SOD1; (-) strand; PAM type: NRG; PAM sequence: GAG
ataacattaatcctagtaga

SEQ ID NO: 8477 - DNA, 20 bp, Artificial Sequence
  Description of Artificial Sequence: Synthetic oligonucleotide
  Target: SOD1; (-) strand; PAM type: NRG; PAM sequence: GAG
aaataacattaatcctagta

SEQ ID NO: 8478 - DNA, 20 bp, Artificial Sequence
  Description of Artificial Sequence: Synthetic oligonucleotide
  Target: SOD1; (-) strand; PAM type: NRG; PAM sequence: TAG
aaaaataacattaatcctag

SEQ ID NO: 8479 - DNA, 20 bp, Artificial Sequence
  Description of Artificial Sequence: Synthetic oligonucleotide
  Target: SOD1; (-) strand; PAM type: NRG; PAM sequence: TAG
tagaaaaataacattaatcc

SEQ ID NO: 8480 - DNA, 20 bp, Artificial Sequence
  Description of Artificial Sequence: Synthetic oligonucleotide
  Target: SOD1; (-) strand; PAM type: NRG; PAM sequence: TAG
gtttaagaacctcataatat

SEQ ID NO: 8481 - DNA, 20 bp, Artificial Sequence
  Description of Artificial Sequence: Synthetic oligonucleotide
  Target: SOD1; (-) strand; PAM type: NRG; PAM sequence: AAG
acaatacccaaaagatgttt

SEQ ID NO: 8482 - DNA, 20 bp, Artificial Sequence
  Description of Artificial Sequence: Synthetic oligonucleotide
  Target: SOD1; (-) strand; PAM type: NRG; PAM sequence: AAG
ctcctcccaacaatacccaa

SEQ ID NO: 8483 - DNA, 20 bp, Artificial Sequence
  Description of Artificial Sequence: Synthetic oligonucleotide
  Target: SOD1; (-) strand; PAM type: NRG; PAM sequence: AAG
gaagataactttgggctgtc

SEQ ID NO: 8484 - DNA, 20 bp, Artificial Sequence
  Description of Artificial Sequence: Synthetic oligonucleotide
  Target: SOD1; (-) strand; PAM type: NRG; PAM sequence: GGG
aattttaagaagataacttt

SEQ ID NO: 8485 - DNA, 20 bp, Artificial Sequence
  Description of Artificial Sequence: Synthetic oligonucleotide
  Target: SOD1; (-) strand; PAM type: NRG; PAM sequence: TGG
aaattttaagaagataactt

SEQ ID NO: 8486 - DNA, 20 bp, Artificial Sequence
  Description of Artificial Sequence: Synthetic oligonucleotide
  Target: SOD1; (-) strand; PAM type: NRG; PAM sequence: AAG
gacctgtaaaaaattttaag

SEQ ID NO: 8487 - DNA, 20 bp, Artificial Sequence
  Description of Artificial Sequence: Synthetic oligonucleotide
  Target: SOD1; (-) strand; PAM type: NRG; PAM sequence: AAG
atggacctgtaaaaaatttt

SEQ ID NO: 8488 - DNA, 20 bp, Artificial Sequence
  Description of Artificial Sequence: Synthetic oligonucleotide
  Target: SOD1; (-) strand; PAM type: NRG; PAM sequence: TGG
ccaagtcatctgctttttca

SEQ ID NO: 8489 - DNA, 20 bp, Artificial Sequence
  Description of Artificial Sequence: Synthetic oligonucleotide
  Target: SOD1; (-) strand; PAM type: NRG; PAM sequence: AAG
cttcatttccacctttgccc

SEQ ID NO: 8490 - DNA, 20 bp, Artificial Sequence
  Description of Artificial Sequence: Synthetic oligonucleotide
  Target: SOD1; (-) strand; PAM type: NRG; PAM sequence: CAG
accacaagccaaacgacttc

SEQ ID NO: 8491 - DNA, 20 bp, Artificial Sequence
  Description of Artificial Sequence: Synthetic oligonucleotide
  Target: SOD1; (-) strand; PAM type: NRG; PAM sequence: AAG
ggcgatcccaattacaccac

SEQ ID NO: 8492 - DNA, 20 bp, Artificial Sequence
  Description of Artificial Sequence: Synthetic oligonucleotide
  Target: SOD1; (-) strand; PAM type: NRG; PAM sequence: GGG
catccaagggaatgtttatt

SEQ ID NO: 8493 - DNA, 20 bp, Artificial Sequence
  Description of Artificial Sequence: Synthetic oligonucleotide
  Target: SOD1; (-) strand; PAM type: NRG; PAM sequence: TGG
acatccaagggaatgtttat

SEQ ID NO: 8494 - DNA, 20 bp, Artificial Sequence
  Description of Artificial Sequence: Synthetic oligonucleotide
  Target: SOD1; (-) strand; PAM type: NRG; PAM sequence: GGG
gggcctcagactacatccaa

SEQ ID NO: 8495 - DNA, 20 bp, Artificial Sequence
  Description of Artificial Sequence: Synthetic oligonucleotide
  Target: SOD1; (-) strand; PAM type: NRG; PAM sequence: AGG
ggggcctcagactacatcca

SEQ ID NO: 8496 - DNA, 20 bp, Artificial Sequence
  Description of Artificial Sequence: Synthetic oligonucleotide
  Target: SOD1; (-) strand; PAM type: NRG; PAM sequence: AAG
aggggcctcagactacatcc

SEQ ID NO: 8497 - DNA, 20 bp, Artificial Sequence
  Description of Artificial Sequence: Synthetic oligonucleotide
  Target: SOD1; (-) strand; PAM type: NRG; PAM sequence: CAG
acagatgagttaaggggcct

SEQ ID NO: 8498 - DNA, 20 bp, Artificial Sequence
  Description of Artificial Sequence: Synthetic oligonucleotide
  Target: SOD1; (-) strand; PAM type: NRG; PAM sequence: GGG
aggataacagatgagttaag

SEQ ID NO: 8499 - DNA, 20 bp, Artificial Sequence
  Description of Artificial Sequence: Synthetic oligonucleotide
  Target: SOD1; (-) strand; PAM type: NRG; PAM sequence: GGG
caggataacagatgagttaa

SEQ ID NO: 8500 - DNA, 20 bp, Artificial Sequence
  Description of Artificial Sequence: Synthetic oligonucleotide
  Target: SOD1; (-) strand; PAM type: NRG; PAM sequence: AGG
gcaggataacagatgagtta

SEQ ID NO: 8501 - DNA, 20 bp, Artificial Sequence
  Description of Artificial Sequence: Synthetic oligonucleotide
  Target: SOD1; (-) strand; PAM type: NRG; PAM sequence: AAG
agcaggataacagatgagtt

SEQ ID NO: 8502 - DNA, 20 bp, Artificial Sequence
  Description of Artificial Sequence: Synthetic oligonucleotide
  Target: SOD1; (-) strand; PAM type: NRG; PAM sequence: GAG
cagctagcaggataacagat

SEQ ID NO: 8503 - DNA, 20 bp, Artificial Sequence
  Description of Artificial Sequence: Synthetic oligonucleotide
  Target: SOD1; (-) strand; PAM type: NRG; PAM sequence: CAG
ttctacagctagcaggataa

SEQ ID NO: 8504 - DNA, 20 bp, Artificial Sequence
  Description of Artificial Sequence: Synthetic oligonucleotide
  Target: SOD1; (-) strand; PAM type: NRG; PAM sequence: AGG
gatacatttctacagctagc

SEQ ID NO: 8505 - DNA, 20 bp, Artificial Sequence
  Description of Artificial Sequence: Synthetic oligonucleotide
  Target: SOD1; (-) strand; PAM type: NRG; PAM sequence: CAG
ggatacatttctacagctag

SEQ ID NO: 8506 - DNA, 20 bp, Artificial Sequence
  Description of Artificial Sequence: Synthetic oligonucleotide
  Target: SOD1; (-) strand; PAM type: NRG; PAM sequence: TAG
tcaggatacatttctacagc

SEQ ID NO: 8507 - DNA, 20 bp, Artificial Sequence
  Description of Artificial Sequence: Synthetic oligonucleotide
  Target: SOD1; (-) strand; PAM type: NRG; PAM sequence: CAG
tttatcaggatacatttcta

SEQ ID NO: 8508 - DNA, 20 bp, Artificial Sequence
  Description of Artificial Sequence: Synthetic oligonucleotide
  Target: SOD1; (-) strand; PAM type: NRG; PAM sequence: AGG
tacagtgtttaatgtttatc

SEQ ID NO: 8509 - DNA, 20 bp, Artificial Sequence
  Description of Artificial Sequence: Synthetic oligonucleotide
  Target: SOD1; (-) strand; PAM type: NRG; PAM sequence: CAG
ttacagtgtttaatgtttat

SEQ ID NO: 8510 - DNA, 20 bp, Artificial Sequence
  Description of Artificial Sequence: Synthetic oligonucleotide
  Target: SOD1; (-) strand; PAM type: NRG; PAM sequence: CAG
caattacacttttaagatta

SEQ ID NO: 8511 - DNA, 20 bp, Artificial Sequence
  Description of Artificial Sequence: Synthetic oligonucleotide
  Target: SOD1; (-) strand; PAM type: NRG; PAM sequence: AAG
agtcacacaattacactttt

SEQ ID NO: 8512 - DNA, 20 bp, Artificial Sequence
  Description of Artificial Sequence: Synthetic oligonucleotide
  Target: SOD1; (-) strand; PAM type: NRG; PAM sequence: AAG
actttaaagcaactctgaaa

SEQ ID NO: 8513 - DNA, 20 bp, Artificial Sequence
  Description of Artificial Sequence: Synthetic oligonucleotide
  Target: SOD1; (-) strand; PAM type: NRG; PAM sequence: AAG
ttctcactacaggtacttta

SEQ ID NO: 8514 - DNA, 20 bp, Artificial Sequence
  Description of Artificial Sequence: Synthetic oligonucleotide
  Target: SOD1; (-) strand; PAM type: NRG; PAM sequence: AGG
ataaatcagtttctcactac

SEQ ID NO: 8515 - DNA, 20 bp, Artificial Sequence
  Description of Artificial Sequence: Synthetic oligonucleotide
  Target: SOD1; (-) strand; PAM type: NRG; PAM sequence: CAG
cataaatcagtttctcacta

SEQ ID NO: 8516 - DNA, 20 bp, Artificial Sequence
  Description of Artificial Sequence: Synthetic oligonucleotide
  Target: SOD1; (-) strand; PAM type: NRG; PAM sequence: CAG
tcttccaagtgatcataaat

SEQ ID NO: 8517 - DNA, 20 bp, Artificial Sequence
  Description of Artificial Sequence: Synthetic oligonucleotide
  Target: SOD1; (-) strand; PAM type: NRG; PAM sequence: AAG
taaaactatacaaatcttcc

SEQ ID NO: 8518 - DNA, 20 bp, Artificial Sequence
  Description of Artificial Sequence: Synthetic oligonucleotide
  Target: SOD1; (-) strand; PAM type: NRG; PAM sequence: GAG
ttgaaacagacattttaact

SEQ ID NO: 8519 - DNA, 20 bp, Artificial Sequence
  Description of Artificial Sequence: Synthetic oligonucleotide
  Target: SOD1; (-) strand; PAM type: NRG; PAM sequence: CAG
caaaatacaggtcattgaaa

SEQ ID NO: 8520 - DNA, 20 bp, Artificial Sequence
  Description of Artificial Sequence: Synthetic oligonucleotide
  Target: SOD1; (-) strand; PAM type: NRG; PAM sequence: AGG
atttaagtctggcaaaatac

SEQ ID NO: 8521 - DNA, 20 bp, Artificial Sequence
  Description of Artificial Sequence: Synthetic oligonucleotide
  Target: SOD1; (-) strand; PAM type: NRG; PAM sequence: CAG
gatttaagtctggcaaaata

SEQ ID NO: 8522 - DNA, 20 bp, Artificial Sequence
  Description of Artificial Sequence: Synthetic oligonucleotide
  Target: SOD1; (-) strand; PAM type: NRG; PAM sequence: TGG
acccatctgtgatttaagtc

SEQ ID NO: 8523 - DNA, 20 bp, Artificial Sequence
  Description of Artificial Sequence: Synthetic oligonucleotide
  Target: SOD1; (-) strand; PAM type: NRG; PAM sequence: AAG
ttaatacccatctgtgattt

SEQ ID NO: 8524 - DNA, 20 bp, Artificial Sequence
  Description of Artificial Sequence: Synthetic oligonucleotide
  Target: SOD1; (-) strand; PAM type: NRG; PAM sequence: AAG
aatgacaaagaaattctgac

SEQ ID NO: 8525 - DNA, 20 bp, Artificial Sequence
  Description of Artificial Sequence: Synthetic oligonucleotide
  Target: SOD1; (-) strand; PAM type: NRG; PAM sequence: AAG
attcacaggcttgaatgaca

SEQ ID NO: 8526 - DNA, 20 bp, Artificial Sequence
  Description of Artificial Sequence: Synthetic oligonucleotide
  Target: SOD1; (-) strand; PAM type: NRG; PAM sequence: AGG
catacagggtttttattcac

SEQ ID NO: 8527 - DNA, 20 bp, Artificial Sequence
  Description of Artificial Sequence: Synthetic oligonucleotide
  Target: SOD1; (-) strand; PAM type: NRG; PAM sequence: CAG
ccatacagggtttttattca

SEQ ID NO: 8528 - DNA, 20 bp, Artificial Sequence
  Description of Artificial Sequence: Synthetic oligonucleotide
  Target: SOD1; (-) strand; PAM type: NRG; PAM sequence: GGG
ctcataataagtgccataca

SEQ ID NO: 8529 - DNA, 20 bp, Artificial Sequence
  Description of Artificial Sequence: Synthetic oligonucleotide
  Target: SOD1; (-) strand; PAM type: NRG; PAM sequence: AGG
cctcataataagtgccatac

SEQ ID NO: 8530 - DNA, 20 bp, Artificial Sequence
  Description of Artificial Sequence: Synthetic oligonucleotide
  Target: SOD1; (-) strand; PAM type: NRG; PAM sequence: CAG
gcctcataataagtgccata

SEQ ID NO: 8531 - DNA, 20 bp, Artificial Sequence
  Description of Artificial Sequence: Synthetic oligonucleotide
  Target: SOD1; (-) strand; PAM type: NRG; PAM sequence: AAG
tcttttaatagcctcataat

SEQ ID NO: 8532 - DNA, 20 bp, Artificial Sequence
  Description of Artificial Sequence: Synthetic oligonucleotide
  Target: SOD1; (-) strand; PAM type: NRG; PAM sequence: TAG
ttgaatttggattcttttaa

SEQ ID NO: 8533 - DNA, 20 bp, Artificial Sequence
  Description of Artificial Sequence: Synthetic oligonucleotide
  Target: SOD1; (-) strand; PAM type: NRG; PAM sequence: TGG
gagctaatttagtttgaatt

SEQ ID NO: 8534 - DNA, 20 bp, Artificial Sequence
  Description of Artificial Sequence: Synthetic oligonucleotide
  Target: SOD1; (-) strand; PAM type: NRG; PAM sequence: TAG
aataagtatcagagctaatt

SEQ ID NO: 8535 - DNA, 20 bp, Artificial Sequence
  Description of Artificial Sequence: Synthetic oligonucleotide
  Target: SOD1; (-) strand; PAM type: NRG; PAM sequence: GAG
gtttatataaataagtatca

SEQ ID NO: 8536 - DNA, 20 bp, Artificial Sequence
  Description of Artificial Sequence: Synthetic oligonucleotide
  Target: SOD1; (-) strand; PAM type: NRG; PAM sequence: CAG
ctgtttatataaataagtat

SEQ ID NO: 8537 - DNA, 20 bp, Artificial Sequence
  Description of Artificial Sequence: Synthetic oligonucleotide
  Target: SOD1; (-) strand; PAM type: NRG; PAM sequence: AAG
ctgaagctgtttatataaat

SEQ ID NO: 8538 - DNA, 20 bp, Artificial Sequence
  Description of Artificial Sequence: Synthetic oligonucleotide
  Target: SOD1; (-) strand; PAM type: NRG; PAM sequence: AAG
ttactaaatctgttccactg

SEQ ID NO: 8539 - DNA, 20 bp, Artificial Sequence
  Description of Artificial Sequence: Synthetic oligonucleotide
  Target: SOD1; (-) strand; PAM type: NRG; PAM sequence: TAG
aaataaaatgctatcactgt

SEQ ID NO: 8540 - DNA, 20 bp, Artificial Sequence
  Description of Artificial Sequence: Synthetic oligonucleotide
  Target: SOD1; (-) strand; PAM type: NRG; PAM sequence: TGG
ttttaaagtatgcattttga

SEQ ID NO: 8541 - DNA, 20 bp, Artificial Sequence
  Description of Artificial Sequence: Synthetic oligonucleotide
  Target: SOD1; (-) strand; PAM type: NRG; PAM sequence: AAG
ctaaaagacctgctgtttta

SEQ ID NO: 8542 - DNA, 20 bp, Artificial Sequence
  Description of Artificial Sequence: Synthetic oligonucleotide
  Target: SOD1; (-) strand; PAM type: NRG; PAM sequence: AAG
gttgtgttagttttagctaa

SEQ ID NO: 8543 - DNA, 20 bp, Artificial Sequence
  Description of Artificial Sequence: Synthetic oligonucleotide
  Target: SOD1; (-) strand; PAM type: NRG; PAM sequence: TAG
aagcagagttgtgttagttt

SEQ ID NO: 8544 - DNA, 20 bp, Artificial Sequence
  Description of Artificial Sequence: Synthetic oligonucleotide
  Target: SOD1; (-) strand; PAM type: NRG; PAM sequence: TAG
ttgtctaagcagagttgtgt

SEQ ID NO: 8545 - DNA, 20 bp, Artificial Sequence
  Description of Artificial Sequence: Synthetic oligonucleotide
  Target: SOD1; (-) strand; PAM type: NRG; PAM sequence: GAG
acagcctatttgtctaagca

SEQ ID NO: 8546 - DNA, 20 bp, Artificial Sequence
  Description of Artificial Sequence: Synthetic oligonucleotide
  Target: SOD1; (-) strand; PAM type: NRG; PAM sequence: CAG
ggacagcctatttgtctaag

SEQ ID NO: 8547 - DNA, 20 bp, Artificial Sequence
  Description of Artificial Sequence: Synthetic oligonucleotide
  Target: SOD1; (-) strand; PAM type: NRG; PAM sequence: AAG
aaaggacagcctatttgtct

SEQ ID NO: 8548 - DNA, 20 bp, Artificial Sequence
  Description of Artificial Sequence: Synthetic oligonucleotide
  Target: SOD1; (-) strand; PAM type: NRG; PAM sequence: CAG
tccctaaagctttcaaagga

SEQ ID NO: 8549 - DNA, 20 bp, Artificial Sequence
  Description of Artificial Sequence: Synthetic oligonucleotide
  Target: SOD1; (-) strand; PAM type: NRG; PAM sequence: AGG
catttccctaaagctttcaa

SEQ ID NO: 8550 - DNA, 20 bp, Artificial Sequence
  Description of Artificial Sequence: Synthetic oligonucleotide
  Target: SOD1; (-) strand; PAM type: NRG; PAM sequence: AAG
acatttccctaaagctttca

SEQ ID NO: 8551 - DNA, 20 bp, Artificial Sequence
  Description of Artificial Sequence: Synthetic oligonucleotide
  Target: SOD1; (-) strand; PAM type: NRG; PAM sequence: AAG
taagcaggaacatttcccta

SEQ ID NO: 8552 - DNA, 20 bp, Artificial Sequence
  Description of Artificial Sequence: Synthetic oligonucleotide
  Target: SOD1; (-) strand; PAM type: NRG; PAM sequence: AGG
aaatgctaaaatgactaagc

SEQ ID NO: 8553 - DNA, 20 bp, Artificial Sequence
  Description of Artificial Sequence: Synthetic oligonucleotide
  Target: SOD1; (-) strand; PAM type: NRG; PAM sequence: CAG
aaaatgctaaaatgactaag

SEQ ID NO: 8554 - DNA, 20 bp, Artificial Sequence
  Description of Artificial Sequence: Synthetic oligonucleotide
  Target: SOD1; (-) strand; PAM type: NRG; PAM sequence: AAG
atcaaaatgctaaaatgact

SEQ ID NO: 8555 - DNA, 20 bp, Artificial Sequence
  Description of Artificial Sequence: Synthetic oligonucleotide
  Target: SOD1; (-) strand; PAM type: NRG; PAM sequence: AGG
aatgtctttttaaaatgagg

SEQ ID NO: 8556 - DNA, 20 bp, Artificial Sequence
  Description of Artificial Sequence: Synthetic oligonucleotide
  Target: SOD1; (-) strand; PAM type: NRG; PAM sequence: GAG
taatgtctttttaaaatgag

SEQ ID NO: 8557 - DNA, 20 bp, Artificial Sequence
  Description of Artificial Sequence: Synthetic oligonucleotide
  Target: SOD1; (-) strand; PAM type: NRG; PAM sequence: AGG
cataatgtctttttaaaatg

SEQ ID NO: 8558 - DNA, 20 bp, Artificial Sequence
  Description of Artificial Sequence: Synthetic oligonucleotide
  Target: SOD1; (-) strand; PAM type: NRG; PAM sequence: GAG
tcataatgtctttttaaaat

SEQ ID NO: 8559 - DNA, 20 bp, Artificial Sequence
  Description of Artificial Sequence: Synthetic oligonucleotide
  Target: SOD1; (-) strand; PAM type: NRG; PAM sequence: TGG
ctcactaaaaagttatcaaa

SEQ ID NO: 8560 - DNA, 20 bp, Artificial Sequence
  Description of Artificial Sequence: Synthetic oligonucleotide
  Target: SOD1; (-) strand; PAM type: NRG; PAM sequence: AAG
gcctttcaaagctcactaaa

SEQ ID NO: 8561 - DNA, 20 bp, Artificial Sequence
  Description of Artificial Sequence: Synthetic oligonucleotide
  Target: SOD1; (-) strand; PAM type: NRG; PAM sequence: AAG
aggctgtaacttgcctttca

SEQ ID NO: 8562 - DNA, 20 bp, Artificial Sequence
  Description of Artificial Sequence: Synthetic oligonucleotide
  Target: SOD1; (-) strand; PAM type: NRG; PAM sequence: AGG
ataatcttactagctagctg

SEQ ID NO: 8563 - DNA, 20 bp, Artificial Sequence
  Description of Artificial Sequence: Synthetic oligonucleotide
  Target: SOD1; (-) strand; PAM type: NRG; PAM sequence: GAG
gataatcttactagctagct

SEQ ID NO: 8564 - DNA, 20 bp, Artificial Sequence
  Description of Artificial Sequence: Synthetic oligonucleotide
  Target: SOD1; (-) strand; PAM type: NRG; PAM sequence: TAG
aggtagataatcttactagc

SEQ ID NO: 8565 - DNA, 20 bp, Artificial Sequence
  Description of Artificial Sequence: Synthetic oligonucleotide
  Target: SOD1; (-) strand; PAM type: NRG; PAM sequence: TAG
tggcaggtagataatcttac

SEQ ID NO: 8566 - DNA, 20 bp, Artificial Sequence
  Description of Artificial Sequence: Synthetic oligonucleotide
  Target: SOD1; (-) strand; PAM type: NRG; PAM sequence: TAG
atttgtgccattctggcagg

SEQ ID NO: 8567 - DNA, 20 bp, Artificial Sequence
  Description of Artificial Sequence: Synthetic oligonucleotide
  Target: SOD1; (-) strand; PAM type: NRG; PAM sequence: AGG
agaatttgtgccattctggc

SEQ ID NO: 8568 - DNA, 20 bp, Artificial Sequence
  Description of Artificial Sequence: Synthetic oligonucleotide
  Target: SOD1; (-) strand; PAM type: NRG; PAM sequence: CAG
tagaatttgtgccattctgg

SEQ ID NO: 8569 - DNA, 20 bp, Artificial Sequence
  Description of Artificial Sequence: Synthetic oligonucleotide
  Target: SOD1; (-) strand; PAM type: NRG; PAM sequence: TGG
atgtagaatttgtgccattc

SEQ ID NO: 8570 - DNA, 20 bp, Artificial Sequence
  Description of Artificial Sequence: Synthetic oligonucleotide
  Target: SOD1; (-) strand; PAM type: NRG; PAM sequence: TAG
ccagcgtctacccttgaatg

SEQ ID NO: 8571 - DNA, 20 bp, Artificial Sequence
  Description of Artificial Sequence: Synthetic oligonucleotide
  Target: SOD1; (-) strand; PAM type: NRG; PAM sequence: CAG
aatctgtaagtaggttgtgc

SEQ ID NO: 8572 - DNA, 20 bp, Artificial Sequence
  Description of Artificial Sequence: Synthetic oligonucleotide
  Target: SOD1; (-) strand; PAM type: NRG; PAM sequence: AGG
taaagggctaatctgtaagt

SEQ ID NO: 8573 - DNA, 20 bp, Artificial Sequence
  Description of Artificial Sequence: Synthetic oligonucleotide
  Target: SOD1; (-) strand; PAM type: NRG; PAM sequence: TAG
ttaaagggctaatctgtaag

SEQ ID NO: 8574 - DNA, 20 bp, Artificial Sequence
  Description of Artificial Sequence: Synthetic oligonucleotide
  Target: SOD1; (-) strand; PAM type: NRG; PAM sequence: AAG
gctttaaagggctaatctgt

SEQ ID NO: 8575 - DNA, 20 bp, Artificial Sequence
  Description of Artificial Sequence: Synthetic oligonucleotide
  Target: SOD1; (-) strand; PAM type: NRG; PAM sequence: GGG
atgctacagattgctttaaa

SEQ ID NO: 8576 - DNA, 20 bp, Artificial Sequence
  Description of Artificial Sequence: Synthetic oligonucleotide
  Target: SOD1; (-) strand; PAM type: NRG; PAM sequence: AGG
aatgctacagattgctttaa

SEQ ID NO: 8577 - DNA, 20 bp, Artificial Sequence
  Description of Artificial Sequence: Synthetic oligonucleotide
  Target: SOD1; (-) strand; PAM type: NRG; PAM sequence: AAG
taatgctacagattgcttta

SEQ ID NO: 8578 - DNA, 20 bp, Artificial Sequence
  Description of Artificial Sequence: Synthetic oligonucleotide
  Target: SOD1; (-) strand; PAM type: NRG; PAM sequence: CAG
ggttccatcttctaatgcta

SEQ ID NO: 8579 - DNA, 20 bp, Artificial Sequence
  Description of Artificial Sequence: Synthetic oligonucleotide
  Target: SOD1; (-) strand; PAM type: NRG; PAM sequence: TGG
cccacagtcaaacatttcct

SEQ ID NO: 8580 - DNA, 20 bp, Artificial Sequence
  Description of Artificial Sequence: Synthetic oligonucleotide
  Target: SOD1; (-) strand; PAM type: NRG; PAM sequence: CAG
ttctcaacagccagaaccca

SEQ ID NO: 8581 - DNA, 20 bp, Artificial Sequence
  Description of Artificial Sequence: Synthetic oligonucleotide
  Target: SOD1; (-) strand; PAM type: NRG; PAM sequence: CAG
gtaaattatttctcaacagc

SEQ ID NO: 8582 - DNA, 20 bp, Artificial Sequence
  Description of Artificial Sequence: Synthetic oligonucleotide
  Target: SOD1; (-) strand; PAM type: NRG; PAM sequence: CAG
gtgtgtaaattatttctcaa

SEQ ID NO: 8583 - DNA, 20 bp, Artificial Sequence
  Description of Artificial Sequence: Synthetic oligonucleotide
  Target: SOD1; (-) strand; PAM type: NRG; PAM sequence: CGG
agtgactcatttcactaatt

SEQ ID NO: 8584 - DNA, 20 bp, Artificial Sequence
  Description of Artificial Sequence: Synthetic oligonucleotide
  Target: SOD1; (-) strand; PAM type: NRG; PAM sequence: AAG
tacataaatacattaagaga

SEQ ID NO: 8585 - DNA, 20 bp, Artificial Sequence
  Description of Artificial Sequence: Synthetic oligonucleotide
  Target: SOD1; (-) strand; PAM type: NRG; PAM sequence: GAG
caggtacataaatacattaa

SEQ ID NO: 8586 - DNA, 20 bp, Artificial Sequence
  Description of Artificial Sequence: Synthetic oligonucleotide
  Target: SOD1; (-) strand; PAM type: NRG; PAM sequence: AAG
ctcaggtacataaatacatt

SEQ ID NO: 8587 - DNA, 20 bp, Artificial Sequence
  Description of Artificial Sequence: Synthetic oligonucleotide
  Target: SOD1; (-) strand; PAM type: NRG; PAM sequence: AGG
acattgaaaagcattctctc

SEQ ID NO: 8588 - DNA, 20 bp, Artificial Sequence
  Description of Artificial Sequence: Synthetic oligonucleotide
  Target: SOD1; (-) strand; PAM type: NRG; PAM sequence: CAG
aacattgaaaagcattctct

SEQ ID NO: 8589 - DNA, 20 bp, Artificial Sequence
  Description of Artificial Sequence: Synthetic oligonucleotide
  Target: SOD1; (-) strand; PAM type: NRG; PAM sequence: AAG
tgagttaggttaacattgaa

SEQ ID NO: 8590 - DNA, 20 bp, Artificial Sequence
  Description of Artificial Sequence: Synthetic oligonucleotide
  Target: SOD1; (-) strand; PAM type: NRG; PAM sequence: AGG
aatttagtcaaacctgagtt

SEQ ID NO: 8591 - DNA, 20 bp, Artificial Sequence
  Description of Artificial Sequence: Synthetic oligonucleotide
  Target: SOD1; (-) strand; PAM type: NRG; PAM sequence: TAG
taatttagtcaaacctgagt

SEQ ID NO: 8592 - DNA, 20 bp, Artificial Sequence
  Description of Artificial Sequence: Synthetic oligonucleotide
  Target: SOD1; (-) strand; PAM type: NRG; PAM sequence: GAG
tgaataatttagtcaaacct

SEQ ID NO: 8593 - DNA, 20 bp, Artificial Sequence
  Description of Artificial Sequence: Synthetic oligonucleotide
  Target: SOD1; (-) strand; PAM type: NRG; PAM sequence: TAG
caatttccaattgaataatt

SEQ ID NO: 8594 - DNA, 20 bp, Artificial Sequence
  Description of Artificial Sequence: Synthetic oligonucleotide
  Target: SOD1; (-) strand; PAM type: NRG; PAM sequence: CAG
ttcacttatttctggtttat

SEQ ID NO: 8595 - DNA, 20 bp, Artificial Sequence
  Description of Artificial Sequence: Synthetic oligonucleotide
  Target: SOD1; (-) strand; PAM type: NRG; PAM sequence: TGG
aacagcatttcacttatttc

SEQ ID NO: 8596 - DNA, 20 bp, Artificial Sequence
  Description of Artificial Sequence: Synthetic oligonucleotide
  Target: SOD1; (-) strand; PAM type: NRG; PAM sequence: CAG
agtacatatttatgaacaaa

SEQ ID NO: 8597 - DNA, 20 bp, Artificial Sequence
  Description of Artificial Sequence: Synthetic oligonucleotide
  Target: SOD1; (-) strand; PAM type: NRG; PAM sequence: AAG
gatctctcctacatttgata

SEQ ID NO: 8598 - DNA, 20 bp, Artificial Sequence
  Description of Artificial Sequence: Synthetic oligonucleotide
  Target: SOD1; (-) strand; PAM type: NRG; PAM sequence: TAG
tacagatttgtcttccaatt

SEQ ID NO: 8599 - DNA, 20 bp, Artificial Sequence
  Description of Artificial Sequence: Synthetic oligonucleotide
  Target: SOD1; (-) strand; PAM type: NRG; PAM sequence: CAG
ttaaaactttggaaacacta

SEQ ID NO: 8600 - DNA, 20 bp, Artificial Sequence
  Description of Artificial Sequence: Synthetic oligonucleotide
  Target: SOD1; (-) strand; PAM type: NRG; PAM sequence: TGG
ttaccataattttaaaactt

SEQ ID NO: 8601 - DNA, 20 bp, Artificial Sequence
  Description of Artificial Sequence: Synthetic oligonucleotide
  Target: SOD1; (-) strand; PAM type: NRG; PAM sequence: TGG
ctctactgagatttaaagaa

SEQ ID NO: 8602 - DNA, 20 bp, Artificial Sequence
  Description of Artificial Sequence: Synthetic oligonucleotide
  Target: SOD1; (-) strand; PAM type: NRG; PAM sequence: AAG
aaattctctactgagattta

SEQ ID NO: 8603 - DNA, 20 bp, Artificial Sequence
  Description of Artificial Sequence: Synthetic oligonucleotide
  Target: SOD1; (-) strand; PAM type: NRG; PAM sequence: GAG
ctttttaaaaattctctact

SEQ ID NO: 8604 - DNA, 20 bp, Artificial Sequence
  Description of Artificial Sequence: Synthetic oligonucleotide
  Target: SOD1; (-) strand; PAM type: NRG; PAM sequence: GGG
ataggcaacaaactacatta

SEQ ID NO: 8605 - DNA, 20 bp, Artificial Sequence
  Description of Artificial Sequence: Synthetic oligonucleotide
  Target: SOD1; (-) strand; PAM type: NRG; PAM sequence: AGG
cataggcaacaaactacatt

SEQ ID NO: 8606 - DNA, 20 bp, Artificial Sequence
  Description of Artificial Sequence: Synthetic oligonucleotide
  Target: SOD1; (-) strand; PAM type: NRG; PAM sequence: TAG
acataggcaacaaactacat

SEQ ID NO: 8607 - DNA, 20 bp, Artificial Sequence
  Description of Artificial Sequence: Synthetic oligonucleotide
  Target: SOD1; (-) strand; PAM type: NRG; PAM sequence: AGG
ctaattgagttattccacat

SEQ ID NO: 8608 - DNA, 20 bp, Artificial Sequence
  Description of Artificial Sequence: Synthetic oligonucleotide
  Target: SOD1; (-) strand; PAM type: NRG; PAM sequence: TAG
tctaattgagttattccaca

SEQ ID NO: 8609 - DNA, 20 bp, Artificial Sequence
  Description of Artificial Sequence: Synthetic oligonucleotide
  Target: SOD1; (-) strand; PAM type: NRG; PAM sequence: GAG
gcataagtgagtctctaatt

SEQ ID NO: 8610 - DNA, 20 bp, Artificial Sequence
  Description of Artificial Sequence: Synthetic oligonucleotide
  Target: SOD1; (-) strand; PAM type: NRG; PAM sequence: GAG
aagtttcaaaaggcataagt

SEQ ID NO: 8611 - DNA, 20 bp, Artificial Sequence
  Description of Artificial Sequence: Synthetic oligonucleotide
  Target: SOD1; (-) strand; PAM type: NRG; PAM sequence: AAG
tttgaagtttcaaaaggcat

SEQ ID NO: 8612 - DNA, 20 bp, Artificial Sequence
  Description of Artificial Sequence: Synthetic oligonucleotide
  Target: SOD1; (-) strand; PAM type: NRG; PAM sequence: AGG
attatatttgaagtttcaaa

SEQ ID NO: 8613 - DNA, 20 bp, Artificial Sequence
  Description of Artificial Sequence: Synthetic oligonucleotide
  Target: SOD1; (-) strand; PAM type: NRG; PAM sequence: AAG
aattatatttgaagtttcaa

SEQ ID NO: 8614 - DNA, 20 bp, Artificial Sequence
  Description of Artificial Sequence: Synthetic oligonucleotide
  Target: SOD1; (-) strand; PAM type: NRG; PAM sequence: AAG
tggtagtgtaattatatttg

SEQ ID NO: 8615 - DNA, 20 bp, Artificial Sequence
  Description of Artificial Sequence: Synthetic oligonucleotide
  Target: SOD1; (-) strand; PAM type: NRG; PAM sequence: TAG
tatgcacatgtaaaaactgg

SEQ ID NO: 8616 - DNA, 20 bp, Artificial Sequence
  Description of Artificial Sequence: Synthetic oligonucleotide
  Target: SOD1; (-) strand; PAM type: NRG; PAM sequence: TGG
ctatatgcacatgtaaaaac

SEQ ID NO: 8617 - DNA, 20 bp, Artificial Sequence
  Description of Artificial Sequence: Synthetic oligonucleotide
  Target: SOD1; (-) strand; PAM type: NRG; PAM sequence: GGG
tatttccaatttaaagtatt

SEQ ID NO: 8618 - DNA, 20 bp, Artificial Sequence
  Description of Artificial Sequence: Synthetic oligonucleotide
  Target: SOD1; (-) strand; PAM type: NRG; PAM sequence: TGG
gtatttccaatttaaagtat

SEQ ID NO: 8619 - DNA, 20 bp, Artificial Sequence
  Description of Artificial Sequence: Synthetic oligonucleotide
  Target: SOD1; (-) strand; PAM type: NRG; PAM sequence: AAG
cagcctgtatttccaattta

SEQ ID NO: 8620 - DNA, 20 bp, Artificial Sequence
  Description of Artificial Sequence: Synthetic oligonucleotide
  Target: SOD1; (-) strand; PAM type: NRG; PAM sequence: CAG
atccagacttgaaggactta

SEQ ID NO: 8621 - DNA, 20 bp, Artificial Sequence
  Description of Artificial Sequence: Synthetic oligonucleotide
  Target: SOD1; (-) strand; PAM type: NRG; PAM sequence: AGG
tacccaacatccagacttga

SEQ ID NO: 8622 - DNA, 20 bp, Artificial Sequence
  Description of Artificial Sequence: Synthetic oligonucleotide
  Target: SOD1; (-) strand; PAM type: NRG; PAM sequence: AAG
ttacccaacatccagacttg

SEQ ID NO: 8623 - DNA, 20 bp, Artificial Sequence
  Description of Artificial Sequence: Synthetic oligonucleotide
  Target: SOD1; (-) strand; PAM type: NRG; PAM sequence: CAG
aaacgtgattacccaacatc

SEQ ID NO: 8624 - DNA, 20 bp, Artificial Sequence
  Description of Artificial Sequence: Synthetic oligonucleotide
  Target: SOD1; (-) strand; PAM type: NRG; PAM sequence: AAG
tcctaacaaatggcttctgg

SEQ ID NO: 8625 - DNA, 20 bp, Artificial Sequence
  Description of Artificial Sequence: Synthetic oligonucleotide
  Target: SOD1; (-) strand; PAM type: NRG; PAM sequence: TGG
aagtcctaacaaatggcttc

SEQ ID NO: 8626 - DNA, 20 bp, Artificial Sequence
  Description of Artificial Sequence: Synthetic oligonucleotide
  Target: SOD1; (-) strand; PAM type: NRG; PAM sequence: TGG
agttttaaagtcctaacaaa

SEQ ID NO: 8627 - DNA, 20 bp, Artificial Sequence
  Description of Artificial Sequence: Synthetic oligonucleotide
  Target: SOD1; (-) strand; PAM type: NRG; PAM sequence: AAG
tggcccactgagaagtttta

SEQ ID NO: 8628 - DNA, 20 bp, Artificial Sequence
  Description of Artificial Sequence: Synthetic oligonucleotide
  Target: SOD1; (-) strand; PAM type: NRG; PAM sequence: AAG
ttttacactggcccactgag

SEQ ID NO: 8629 - DNA, 20 bp, Artificial Sequence
  Description of Artificial Sequence: Synthetic oligonucleotide
  Target: SOD1; (-) strand; PAM type: NRG; PAM sequence: GAG
taattttacactggcccact

SEQ ID NO: 8630 - DNA, 20 bp, Artificial Sequence
  Description of Artificial Sequence: Synthetic oligonucleotide
  Target: SOD1; (-) strand; PAM type: NRG; PAM sequence: TGG
acttgtccttaattttacac

SEQ ID NO: 8631 - DNA, 20 bp, Artificial Sequence
  Description of Artificial Sequence: Synthetic oligonucleotide
  Target: SOD1; (-) strand; PAM type: NRG; PAM sequence: GAG
ttcctgcctttagaaaatga

SEQ ID NO: 8632 - DNA, 20 bp, Artificial Sequence
  Description of Artificial Sequence: Synthetic oligonucleotide
  Target: SOD1; (-) strand; PAM type: NRG; PAM sequence: GAG
tattcctgcctttagaaaat

SEQ ID NO: 8633 - DNA, 20 bp, Artificial Sequence
  Description of Artificial Sequence: Synthetic oligonucleotide
  Target: SOD1; (-) strand; PAM type: NRG; PAM sequence: TAG
tgtccttatattcctgcctt

SEQ ID NO: 8634 - DNA, 20 bp, Artificial Sequence
  Description of Artificial Sequence: Synthetic oligonucleotide
  Target: SOD1; (-) strand; PAM type: NRG; PAM sequence: GGG
tgatggggagaatatatcta

SEQ ID NO: 8635 - DNA, 20 bp, Artificial Sequence
  Description of Artificial Sequence: Synthetic oligonucleotide
  Target: SOD1; (-) strand; PAM type: NRG; PAM sequence: AGG
ttgatggggagaatatatct

SEQ ID NO: 8636 - DNA, 20 bp, Artificial Sequence
  Description of Artificial Sequence: Synthetic oligonucleotide
  Target: SOD1; (-) strand; PAM type: NRG; PAM sequence: TAG
tttgatggggagaatatatc

SEQ ID NO: 8637 - DNA, 20 bp, Artificial Sequence
  Description of Artificial Sequence: Synthetic oligonucleotide
  Target: SOD1; (-) strand; PAM type: NRG; PAM sequence: GAG
aagacctttggtttgatggg

SEQ ID NO: 8638 - DNA, 20 bp, Artificial Sequence
  Description of Artificial Sequence: Synthetic oligonucleotide
  Target: SOD1; (-) strand; PAM type: NRG; PAM sequence: GGG
gcaagacctttggtttgatg

SEQ ID NO: 8639 - DNA, 20 bp, Artificial Sequence
  Description of Artificial Sequence: Synthetic oligonucleotide
  Target: SOD1; (-) strand; PAM type: NRG; PAM sequence: GGG
agcaagacctttggtttgat

SEQ ID NO: 8640 - DNA, 20 bp, Artificial Sequence
  Description of Artificial Sequence: Synthetic oligonucleotide
  Target: SOD1; (-) strand; PAM type: NRG; PAM sequence: TGG
cagcaagacctttggtttga

SEQ ID NO: 8641 - DNA, 20 bp, Artificial Sequence
  Description of Artificial Sequence: Synthetic oligonucleotide
  Target: SOD1; (-) strand; PAM type: NRG; PAM sequence: TGG
atactcagcagcaagacctt

SEQ ID NO: 8642 - DNA, 20 bp, Artificial Sequence
  Description of Artificial Sequence: Synthetic oligonucleotide
  Target: SOD1; (-) strand; PAM type: NRG; PAM sequence: AAG
tttaaataatactcagcagc

SEQ ID NO: 8643 - DNA, 20 bp, Artificial Sequence
  Description of Artificial Sequence: Synthetic oligonucleotide
  Target: SOD1; (-) strand; PAM type: NRG; PAM sequence: CAG
ggtttttaaataatactcag

SEQ ID NO: 8644 - DNA, 20 bp, Artificial Sequence
  Description of Artificial Sequence: Synthetic oligonucleotide
  Target: SOD1; (-) strand; PAM type: NRG; PAM sequence: CAG
tctggtttttaaataatact

SEQ ID NO: 8645 - DNA, 20 bp, Artificial Sequence
  Description of Artificial Sequence: Synthetic oligonucleotide
  Target: SOD1; (-) strand; PAM type: NRG; PAM sequence: TGG
gcgaagctgctttattactc

SEQ ID NO: 8646 - DNA, 20 bp, Artificial Sequence
  Description of Artificial Sequence: Synthetic oligonucleotide
  Target: SOD1; (-) strand; PAM type: NRG; PAM sequence: AAG
tttgccttcatcctcaggcg

SEQ ID NO: 8647 - DNA, 20 bp, Artificial Sequence
  Description of Artificial Sequence: Synthetic oligonucleotide
  Target: SOD1; (-) strand; PAM type: NRG; PAM sequence: AGG
ttgtctttgccttcatcctc

SEQ ID NO: 8648 - DNA, 20 bp, Artificial Sequence
  Description of Artificial Sequence: Synthetic oligonucleotide
  Target: SOD1; (-) strand; PAM type: NRG; PAM sequence: CAG
tttgtctttgccttcatcct

SEQ ID NO: 8649 - DNA, 20 bp, Artificial Sequence
  Description of Artificial Sequence: Synthetic oligonucleotide
  Target: SOD1; (-) strand; PAM type: NRG; PAM sequence: CAG
cctggtttcagtatgctgag

SEQ ID NO: 8650 - DNA, 20 bp, Artificial Sequence
  Description of Artificial Sequence: Synthetic oligonucleotide
  Target: SOD1; (-) strand; PAM type: NRG; PAM sequence: GAG
actcctggtttcagtatgct

SEQ ID NO: 8651 - DNA, 20 bp, Artificial Sequence
  Description of Artificial Sequence: Synthetic oligonucleotide
  Target: SOD1; (-) strand; PAM type: NRG; PAM sequence: CAG
ctttttcaaactcctggttt

SEQ ID NO: 8652 - DNA, 20 bp, Artificial Sequence
  Description of Artificial Sequence: Synthetic oligonucleotide
  Target: SOD1; (-) strand; PAM type: NRG; PAM sequence: TGG
gaattactttttcaaactcc

SEQ ID NO: 8653 - DNA, 20 bp, Artificial Sequence
  Description of Artificial Sequence: Synthetic oligonucleotide
  Target: SOD1; (-) strand; PAM type: NRG; PAM sequence: AAG
tccaagtatttatggccttg

SEQ ID NO: 8654 - DNA, 20 bp, Artificial Sequence
  Description of Artificial Sequence: Synthetic oligonucleotide
  Target: SOD1; (-) strand; PAM type: NRG; PAM sequence: TGG
tcacactatccaagtattta

SEQ ID NO: 8655 - DNA, 20 bp, Artificial Sequence
  Description of Artificial Sequence: Synthetic oligonucleotide
  Target: SOD1; (-) strand; PAM type: NRG; PAM sequence: AAG
gacctgatgtcacactatcc

SEQ ID NO: 8656 - DNA, 20 bp, Artificial Sequence
  Description of Artificial Sequence: Synthetic oligonucleotide
  Target: SOD1; (-) strand; PAM type: NRG; PAM sequence: AAG
attgcaggaaatccagtgcc

SEQ ID NO: 8657 - DNA, 20 bp, Artificial Sequence
  Description of Artificial Sequence: Synthetic oligonucleotide
  Target: SOD1; (-) strand; PAM type: NRG; PAM sequence: CAG
atctgaaattgcaggaaatc

SEQ ID NO: 8658 - DNA, 20 bp, Artificial Sequence
  Description of Artificial Sequence: Synthetic oligonucleotide
  Target: SOD1; (-) strand; PAM type: NRG; PAM sequence: AGG
aagccttcatctgaaattgc

SEQ ID NO: 8659 - DNA, 20 bp, Artificial Sequence
  Description of Artificial Sequence: Synthetic oligonucleotide
  Target: SOD1; (-) strand; PAM type: NRG; PAM sequence: CAG
caagccttcatctgaaattg

SEQ ID NO: 8660 - DNA, 20 bp, Artificial Sequence
  Description of Artificial Sequence: Synthetic oligonucleotide
  Target: SOD1; (-) strand; PAM type: NRG; PAM sequence: AAG
aaaacatctaaagccaagtc

SEQ ID NO: 8661 - DNA, 20 bp, Artificial Sequence
  Description of Artificial Sequence: Synthetic oligonucleotide
  Target: SOD1; (-) strand; PAM type: NRG; PAM sequence: AAG
acatgaaaacatctaaagcc

SEQ ID NO: 8662 - DNA, 20 bp, Artificial Sequence
  Description of Artificial Sequence: Synthetic oligonucleotide
  Target: SOD1; (-) strand; PAM type: NRG; PAM sequence: AAG
ttatcacatgaaaacatcta

SEQ ID NO: 8663 - DNA, 20 bp, Artificial Sequence
  Description of Artificial Sequence: Synthetic oligonucleotide
  Target: SOD1; (-) strand; PAM type: NRG; PAM sequence: AAG
aaaatcgttgtaggttatcc

SEQ ID NO: 8664 - DNA, 20 bp, Artificial Sequence
  Description of Artificial Sequence: Synthetic oligonucleotide
  Target: SOD1; (-) strand; PAM type: NRG; PAM sequence: AGG
taaataggaaaaatcgttgt

SEQ ID NO: 8665 - DNA, 20 bp, Artificial Sequence
  Description of Artificial Sequence: Synthetic oligonucleotide
  Target: SOD1; (-) strand; PAM type: NRG; PAM sequence: TAG
ttaaataggaaaaatcgttg

SEQ ID NO: 8666 - DNA, 20 bp, Artificial Sequence
  Description of Artificial Sequence: Synthetic oligonucleotide
  Target: SOD1; (-) strand; PAM type: NRG; PAM sequence: AGG
ttaaagttggtgggttaaat

SEQ ID NO: 8667 - DNA, 20 bp, Artificial Sequence
  Description of Artificial Sequence: Synthetic oligonucleotide
  Target: SOD1; (-) strand; PAM type: NRG; PAM sequence: TAG
cttaaagttggtgggttaaa

SEQ ID NO: 8668 - DNA, 20 bp, Artificial Sequence
  Description of Artificial Sequence: Synthetic oligonucleotide
  Target: SOD1; (-) strand; PAM type: NRG; PAM sequence: GGG
ttcttttgcttaaagttggt

SEQ ID NO: 8669 - DNA, 20 bp, Artificial Sequence
  Description of Artificial Sequence: Synthetic oligonucleotide
  Target: SOD1; (-) strand; PAM type: NRG; PAM sequence: TGG
tttcttttgcttaaagttgg

SEQ ID NO: 8670 - DNA, 20 bp, Artificial Sequence
  Description of Artificial Sequence: Synthetic oligonucleotide
  Target: SOD1; (-) strand; PAM type: NRG; PAM sequence: TGG
ttctttcttttgcttaaagt

SEQ ID NO: 8671 - DNA, 20 bp, Artificial Sequence
  Description of Artificial Sequence: Synthetic oligonucleotide
  Target: SOD1; (-) strand; PAM type: NRG; PAM sequence: AAG
tacgttctttcttttgctta

SEQ ID NO: 8672 - DNA, 20 bp, Artificial Sequence
  Description of Artificial Sequence: Synthetic oligonucleotide
  Target: SOD1; (-) strand; PAM type: NRG; PAM sequence: AGG
ttaattcccctgcggggcag

SEQ ID NO: 8673 - DNA, 20 bp, Artificial Sequence
  Description of Artificial Sequence: Synthetic oligonucleotide
  Target: SOD1; (-) strand; PAM type: NRG; PAM sequence: GAG
tttaattcccctgcggggca

SEQ ID NO: 8674 - DNA, 20 bp, Artificial Sequence
  Description of Artificial Sequence: Synthetic oligonucleotide
  Target: SOD1; (-) strand; PAM type: NRG; PAM sequence: CAG
gttttaattcccctgcgggg

SEQ ID NO: 8675 - DNA, 20 bp, Artificial Sequence
  Description of Artificial Sequence: Synthetic oligonucleotide
  Target: SOD1; (-) strand; PAM type: NRG; PAM sequence: GGG
agcgttttaattcccctgcg

SEQ ID NO: 8676 - DNA, 20 bp, Artificial Sequence
  Description of Artificial Sequence: Synthetic oligonucleotide
  Target: SOD1; (-) strand; PAM type: NRG; PAM sequence: GGG
cagcgttttaattcccctgc

SEQ ID NO: 8677 - DNA, 20 bp, Artificial Sequence
  Description of Artificial Sequence: Synthetic oligonucleotide
  Target: SOD1; (-) strand; PAM type: NRG; PAM sequence: CGG
ccagcgttttaattcccctg

SEQ ID NO: 8678 - DNA, 20 bp, Artificial Sequence
  Description of Artificial Sequence: Synthetic oligonucleotide
  Target: SOD1; (-) strand; PAM type: NRG; PAM sequence: CAG
tgcctgttgcctttcttcac

SEQ ID NO: 8679 - DNA, 20 bp, Artificial Sequence
  Description of Artificial Sequence: Synthetic oligonucleotide
  Target: SOD1; (-) strand; PAM type: NRG; PAM sequence: AAG
ctactactgtttccttatat

SEQ ID NO: 8680 - DNA, 20 bp, Artificial Sequence
  Description of Artificial Sequence: Synthetic oligonucleotide
  Target: SOD1; (-) strand; PAM type: NRG; PAM sequence: CAG
tgtgtttgaggacttcagtg

SEQ ID NO: 8681 - DNA, 20 bp, Artificial Sequence
  Description of Artificial Sequence: Synthetic oligonucleotide
  Target: SOD1; (-) strand; PAM type: NRG; PAM sequence: CAG
tttgttgtgtttgaggactt

SEQ ID NO: 8682 - DNA, 20 bp, Artificial Sequence
  Description of Artificial Sequence: Synthetic oligonucleotide
  Target: SOD1; (-) strand; PAM type: NRG; PAM sequence: AGG
agagctttttgttgtgtttg

SEQ ID NO: 8683 - DNA, 20 bp, Artificial Sequence
  Description of Artificial Sequence: Synthetic oligonucleotide
  Target: SOD1; (-) strand; PAM type: NRG; PAM sequence: GAG
aagagctttttgttgtgttt

SEQ ID NO: 8684 - DNA, 20 bp, Artificial Sequence
  Description of Artificial Sequence: Synthetic oligonucleotide
  Target: SOD1; (-) strand; PAM type: NRG; PAM sequence: GAG
ggttaacatttgcaacctaa

SEQ ID NO: 8685 - DNA, 20 bp, Artificial Sequence
  Description of Artificial Sequence: Synthetic oligonucleotide
  Target: SOD1; (-) strand; PAM type: NRG; PAM sequence: AAG
aaggttaacatttgcaacct

SEQ ID NO: 8686 - DNA, 20 bp, Artificial Sequence
  Description of Artificial Sequence: Synthetic oligonucleotide
  Target: SOD1; (-) strand; PAM type: NRG; PAM sequence: AGG
tcaaaagggtaaaagaatca

SEQ ID NO: 8687 - DNA, 20 bp, Artificial Sequence
  Description of Artificial Sequence: Synthetic oligonucleotide
  Target: SOD1; (-) strand; PAM type: NRG; PAM sequence: AAG
ttcaaaagggtaaaagaatc

SEQ ID NO: 8688 - DNA, 20 bp, Artificial Sequence
  Description of Artificial Sequence: Synthetic oligonucleotide
  Target: SOD1; (-) strand; PAM type: NRG; PAM sequence: AAG
tgaatttttcaaaagggtaa

SEQ ID NO: 8689 - DNA, 20 bp, Artificial Sequence
  Description of Artificial Sequence: Synthetic oligonucleotide
  Target: SOD1; (-) strand; PAM type: NRG; PAM sequence: GGG
tcccattgaatttttcaaaa

SEQ ID NO: 8690 - DNA, 20 bp, Artificial Sequence
  Description of Artificial Sequence: Synthetic oligonucleotide
  Target: SOD1; (-) strand; PAM type: NRG; PAM sequence: AGG
atcccattgaatttttcaaa

SEQ ID NO: 8691 - DNA, 20 bp, Artificial Sequence
  Description of Artificial Sequence: Synthetic oligonucleotide
  Target: SOD1; (-) strand; PAM type: NRG; PAM sequence: AAG
catcccattgaatttttcaa

SEQ ID NO: 8692 - DNA, 20 bp, Artificial Sequence
  Description of Artificial Sequence: Synthetic oligonucleotide
  Target: SOD1; (-) strand; PAM type: NRG; PAM sequence: TGG
tgtgtgtgtgtgtgtgtctg

SEQ ID NO: 8693 - DNA, 20 bp, Artificial Sequence
  Description of Artificial Sequence: Synthetic oligonucleotide
  Target: SOD1; (-) strand; PAM type: NRG; PAM sequence: AGG
tgcctgggtattacgttaga

SEQ ID NO: 8694 - DNA, 20 bp, Artificial Sequence
  Description of Artificial Sequence: Synthetic oligonucleotide
  Target: SOD1; (-) strand; PAM type: NRG; PAM sequence: AAG
ctgcctgggtattacgttag

SEQ ID NO: 8695 - DNA, 20 bp, Artificial Sequence
  Description of Artificial Sequence: Synthetic oligonucleotide
  Target: SOD1; (-) strand; PAM type: NRG; PAM sequence: TAG
ggactgcctgggtattacgt

SEQ ID NO: 8696 - DNA, 20 bp, Artificial Sequence
  Description of Artificial Sequence: Synthetic oligonucleotide
  Target: SOD1; (-) strand; PAM type: NRG; PAM sequence: GGG
tataaattatcggactgcct

SEQ ID NO: 8697 - DNA, 20 bp, Artificial Sequence
  Description of Artificial Sequence: Synthetic oligonucleotide
  Target: SOD1; (-) strand; PAM type: NRG; PAM sequence: TGG
ctataaattatcggactgcc

SEQ ID NO: 8698 - DNA, 20 bp, Artificial Sequence
  Description of Artificial Sequence: Synthetic oligonucleotide
  Target: SOD1; (-) strand; PAM type: NRG; PAM sequence: CGG
cacgttgtactataaattat

SEQ ID NO: 8699 - DNA, 20 bp, Artificial Sequence
  Description of Artificial Sequence: Synthetic oligonucleotide
  Target: SOD1; (-) strand; PAM type: NRG; PAM sequence: CAG
ctgggtgaaaagttggatcc

SEQ ID NO: 8700 - DNA, 20 bp, Artificial Sequence
  Description of Artificial Sequence: Synthetic oligonucleotide
  Target: SOD1; (-) strand; PAM type: NRG; PAM sequence: TGG
gattttgctgggtgaaaagt

SEQ ID NO: 8701 - DNA, 20 bp, Artificial Sequence
  Description of Artificial Sequence: Synthetic oligonucleotide
  Target: SOD1; (-) strand; PAM type: NRG; PAM sequence: AAG
aggagattttgctgggtgaa

SEQ ID NO: 8702 - DNA, 20 bp, Artificial Sequence
  Description of Artificial Sequence: Synthetic oligonucleotide
  Target: SOD1; (-) strand; PAM type: NRG; PAM sequence: GGG
atttgtaaggagattttgct

SEQ ID NO: 8703 - DNA, 20 bp, Artificial Sequence
  Description of Artificial Sequence: Synthetic oligonucleotide
  Target: SOD1; (-) strand; PAM type: NRG; PAM sequence: TGG
aatttgtaaggagattttgc

SEQ ID NO: 8704 - DNA, 20 bp, Artificial Sequence
  Description of Artificial Sequence: Synthetic oligonucleotide
  Target: SOD1; (-) strand; PAM type: NRG; PAM sequence: GAG
atgttgccctaatttgtaag

SEQ ID NO: 8705 - DNA, 20 bp, Artificial Sequence
  Description of Artificial Sequence: Synthetic oligonucleotide
  Target: SOD1; (-) strand; PAM type: NRG; PAM sequence: AGG
atatgttgccctaatttgta

SEQ ID NO: 8706 - DNA, 20 bp, Artificial Sequence
  Description of Artificial Sequence: Synthetic oligonucleotide
  Target: SOD1; (-) strand; PAM type: NRG; PAM sequence: AAG
tatatgttgccctaatttgt

SEQ ID NO: 8707 - DNA, 20 bp, Artificial Sequence
  Description of Artificial Sequence: Synthetic oligonucleotide
  Target: SOD1; (-) strand; PAM type: NRG; PAM sequence: TGG
ttttttttccattggctttg

SEQ ID NO: 8708 - DNA, 20 bp, Artificial Sequence
  Description of Artificial Sequence: Synthetic oligonucleotide
  Target: SOD1; (-) strand; PAM type: NRG; PAM sequence: TGG
ggttttctttttttttccat

SEQ ID NO: 8709 - DNA, 20 bp, Artificial Sequence
  Description of Artificial Sequence: Synthetic oligonucleotide
  Target: SOD1; (-) strand; PAM type: NRG; PAM sequence: AGG
ctgtgtttgcaattcaatcg

SEQ ID NO: 8710 - DNA, 20 bp, Artificial Sequence
  Description of Artificial Sequence: Synthetic oligonucleotide
  Target: SOD1; (-) strand; PAM type: NRG; PAM sequence: GAG
gctgtgtttgcaattcaatc

SEQ ID NO: 8711 - DNA, 20 bp, Artificial Sequence
  Description of Artificial Sequence: Synthetic oligonucleotide
  Target: SOD1; (-) strand; PAM type: NRG; PAM sequence: AAG
ttgttttaatgtcaattgaa

SEQ ID NO: 8712 - DNA, 20 bp, Artificial Sequence
  Description of Artificial Sequence: Synthetic oligonucleotide
  Target: SOD1; (-) strand; PAM type: NRG; PAM sequence: TAG
ctcagtcataaggtaaaggt

SEQ ID NO: 8713 - DNA, 20 bp, Artificial Sequence
  Description of Artificial Sequence: Synthetic oligonucleotide
  Target: SOD1; (-) strand; PAM type: NRG; PAM sequence: AGG
agtgctcagtcataaggtaa

SEQ ID NO: 8714 - DNA, 20 bp, Artificial Sequence
  Description of Artificial Sequence: Synthetic oligonucleotide
  Target: SOD1; (-) strand; PAM type: NRG; PAM sequence: AAG
tagtgctcagtcataaggta

SEQ ID NO: 8715 - DNA, 20 bp, Artificial Sequence
  Description of Artificial Sequence: Synthetic oligonucleotide
  Target: SOD1; (-) strand; PAM type: NRG; PAM sequence: AGG
atttttagtgctcagtcata

SEQ ID NO: 8716 - DNA, 20 bp, Artificial Sequence
  Description of Artificial Sequence: Synthetic oligonucleotide
  Target: SOD1; (-) strand; PAM type: NRG; PAM sequence: AAG
gatttttagtgctcagtcat

SEQ ID NO: 8717 - DNA, 20 bp, Artificial Sequence
  Description of Artificial Sequence: Synthetic oligonucleotide
  Target: SOD1; (-) strand; PAM type: NRG; PAM sequence: CAG
tacttttgatttttagtgct

SEQ ID NO: 8718 - DNA, 20 bp, Artificial Sequence
  Description of Artificial Sequence: Synthetic oligonucleotide
  Target: SOD1; (-) strand; PAM type: NRG; PAM sequence: TAG
tatgtaatacttttgatttt

SEQ ID NO: 8719 - DNA, 20 bp, Artificial Sequence
  Description of Artificial Sequence: Synthetic oligonucleotide
  Target: SOD1; (-) strand; PAM type: NRG; PAM sequence: TAG
atgaaaatagacattttatg

SEQ ID NO: 8720 - DNA, 20 bp, Artificial Sequence
  Description of Artificial Sequence: Synthetic oligonucleotide
  Target: SOD1; (-) strand; PAM type: NRG; PAM sequence: TAG
ttagacttatttgatgaaaa

SEQ ID NO: 8721 - DNA, 20 bp, Artificial Sequence
  Description of Artificial Sequence: Synthetic oligonucleotide
  Target: SOD1; (-) strand; PAM type: NRG; PAM sequence: TAG
tactgtattggagtctaaat

SEQ ID NO: 8722 - DNA, 20 bp, Artificial Sequence
  Description of Artificial Sequence: Synthetic oligonucleotide
  Target: SOD1; (-) strand; PAM type: NRG; PAM sequence: GAG
gagctgttaatactgtattg

SEQ ID NO: 8723 - DNA, 20 bp, Artificial Sequence
  Description of Artificial Sequence: Synthetic oligonucleotide
  Target: SOD1; (-) strand; PAM type: NRG; PAM sequence: TGG
ttgagctgttaatactgtat

SEQ ID NO: 8724 - DNA, 20 bp, Artificial Sequence
  Description of Artificial Sequence: Synthetic oligonucleotide
  Target: SOD1; (-) strand; PAM type: NRG; PAM sequence: GAG
attgttcaccgtcaaagttt

SEQ ID NO: 8725 - DNA, 20 bp, Artificial Sequence
  Description of Artificial Sequence: Synthetic oligonucleotide
  Target: SOD1; (-) strand; PAM type: NRG; PAM sequence: AAG
aaaaggattgttcaccgtca

SEQ ID NO: 8726 - DNA, 20 bp, Artificial Sequence
  Description of Artificial Sequence: Synthetic oligonucleotide
  Target: SOD1; (-) strand; PAM type: NRG; PAM sequence: AGG
acactgcattaaggtggaaa

SEQ ID NO: 8727 - DNA, 20 bp, Artificial Sequence
  Description of Artificial Sequence: Synthetic oligonucleotide
  Target: SOD1; (-) strand; PAM type: NRG; PAM sequence: AAG
tacactgcattaaggtggaa

SEQ ID NO: 8728 - DNA, 20 bp, Artificial Sequence
  Description of Artificial Sequence: Synthetic oligonucleotide
  Target: SOD1; (-) strand; PAM type: NRG; PAM sequence: TGG
cttcctacactgcattaagg

SEQ ID NO: 8729 - DNA, 20 bp, Artificial Sequence
  Description of Artificial Sequence: Synthetic oligonucleotide
  Target: SOD1; (-) strand; PAM type: NRG; PAM sequence: AGG
attcttcctacactgcatta

SEQ ID NO: 8730 - DNA, 20 bp, Artificial Sequence
  Description of Artificial Sequence: Synthetic oligonucleotide
  Target: SOD1; (-) strand; PAM type: NRG; PAM sequence: AAG
tattcttcctacactgcatt

SEQ ID NO: 8731 - DNA, 20 bp, Artificial Sequence
  Description of Artificial Sequence: Synthetic oligonucleotide
  Target: SOD1; (-) strand; PAM type: NRG; PAM sequence: GGG
gaaagctcctcaaaacaata

SEQ ID NO: 8732 - DNA, 20 bp, Artificial Sequence
  Description of Artificial Sequence: Synthetic oligonucleotide
  Target: SOD1; (-) strand; PAM type: NRG; PAM sequence: AGG
tgaaagctcctcaaaacaat

SEQ ID NO: 8733 - DNA, 20 bp, Artificial Sequence
  Description of Artificial Sequence: Synthetic oligonucleotide
  Target: SOD1; (-) strand; PAM type: NRG; PAM sequence: TAG
gtgaaagctcctcaaaacaa

SEQ ID NO: 8734 - DNA, 20 bp, Artificial Sequence
  Description of Artificial Sequence: Synthetic oligonucleotide
  Target: SOD1; (-) strand; PAM type: NRG; PAM sequence: AAG
ttaagacaaggtaacggtga

SEQ ID NO: 8735 - DNA, 20 bp, Artificial Sequence
  Description of Artificial Sequence: Synthetic oligonucleotide
  Target: SOD1; (-) strand; PAM type: NRG; PAM sequence: CGG
tttaatttaagacaaggtaa

SEQ ID NO: 8736 - DNA, 20 bp, Artificial Sequence
  Description of Artificial Sequence: Synthetic oligonucleotide
  Target: SOD1; (-) strand; PAM type: NRG; PAM sequence: AGG
tttttttttaatttaagaca

SEQ ID NO: 8737 - DNA, 20 bp, Artificial Sequence
  Description of Artificial Sequence: Synthetic oligonucleotide
  Target: SOD1; (-) strand; PAM type: NRG; PAM sequence: AAG
ttttttttttaatttaagac

SEQ ID NO: 8738 - DNA, 20 bp, Artificial Sequence
  Description of Artificial Sequence: Synthetic oligonucleotide
  Target: SOD1; (-) strand; PAM type: NRG; PAM sequence: AAG
tttttttttttttttaattt

SEQ ID NO: 8739 - DNA, 20 bp, Artificial Sequence
  Description of Artificial Sequence: Synthetic oligonucleotide
  Target: SOD1; (-) strand; PAM type: NRG; PAM sequence: AAG
agtttacaaatcgtaattag

SEQ ID NO: 8740 - DNA, 20 bp, Artificial Sequence
  Description of Artificial Sequence: Synthetic oligonucleotide
  Target: SOD1; (-) strand; PAM type: NRG; PAM sequence: TAG
aaaagtttacaaatcgtaat

SEQ ID NO: 8741 - DNA, 20 bp, Artificial Sequence
  Description of Artificial Sequence: Synthetic oligonucleotide
  Target: SOD1; (-) strand; PAM type: NRG; PAM sequence: AAG
ttaaaagttttgactttaaa

SEQ ID NO: 8742 - DNA, 20 bp, Artificial Sequence
  Description of Artificial Sequence: Synthetic oligonucleotide
  Target: SOD1; (-) strand; PAM type: NRG; PAM sequence: AAG
tttttgctgtaactttttaa

SEQ ID NO: 8743 - DNA, 20 bp, Artificial Sequence
  Description of Artificial Sequence: Synthetic oligonucleotide
  Target: SOD1; (-) strand; PAM type: NRG; PAM sequence: TAG
gcttcccttctatttaaaaa

SEQ ID NO: 8744 - DNA, 20 bp, Artificial Sequence
  Description of Artificial Sequence: Synthetic oligonucleotide
  Target: SOD1; (-) strand; PAM type: NRG; PAM sequence: AAG
gccagctggtggggaactgt

SEQ ID NO: 8745 - DNA, 20 bp, Artificial Sequence
  Description of Artificial Sequence: Synthetic oligonucleotide
  Target: SOD1; (-) strand; PAM type: NRG; PAM sequence: GGG
cagccccgcgccagctggtg

SEQ ID NO: 8746 - DNA, 20 bp, Artificial Sequence
  Description of Artificial Sequence: Synthetic oligonucleotide
  Target: SOD1; (-) strand; PAM type: NRG; PAM sequence: GGG
gcagccccgcgccagctggt

SEQ ID NO: 8747 - DNA, 20 bp, Artificial Sequence
  Description of Artificial Sequence: Synthetic oligonucleotide
  Target: SOD1; (-) strand; PAM type: NRG; PAM sequence: TGG
tgcagccccgcgccagctgg

SEQ ID NO: 8748 - DNA, 20 bp, Artificial Sequence
  Description of Artificial Sequence: Synthetic oligonucleotide
  Target: SOD1; (-) strand; PAM type: NRG; PAM sequence: TGG
tactgcagccccgcgccagc

SEQ ID NO: 8749 - DNA, 20 bp, Artificial Sequence
  Description of Artificial Sequence: Synthetic oligonucleotide
  Target: SOD1; (-) strand; PAM type: NRG; PAM sequence: CAG
gctgtactgcagccccgcgc

SEQ ID NO: 8750 - DNA, 20 bp, Artificial Sequence
  Description of Artificial Sequence: Synthetic oligonucleotide
  Target: SOD1; (-) strand; PAM type: NRG; PAM sequence: CAG
tatccgctcccgctgtactg

SEQ ID NO: 8751 - DNA, 20 bp, Artificial Sequence
  Description of Artificial Sequence: Synthetic oligonucleotide
  Target: SOD1; (-) strand; PAM type: NRG; PAM sequence: CAG
agtgtagagcttgaggtgta

SEQ ID NO: 8752 - DNA, 20 bp, Artificial Sequence
  Description of Artificial Sequence: Synthetic oligonucleotide
  Target: SOD1; (-) strand; PAM type: NRG; PAM sequence: AGG
ttcctggagtgtagagcttg

SEQ ID NO: 8753 - DNA, 20 bp, Artificial Sequence
  Description of Artificial Sequence: Synthetic oligonucleotide
  Target: SOD1; (-) strand; PAM type: NRG; PAM sequence: GAG
cttcctggagtgtagagctt

SEQ ID NO: 8754 - DNA, 20 bp, Artificial Sequence
  Description of Artificial Sequence: Synthetic oligonucleotide
  Target: SOD1; (-) strand; PAM type: NRG; PAM sequence: GAG
gtgacacttcctggagtgta

SEQ ID NO: 8755 - DNA, 20 bp, Artificial Sequence
  Description of Artificial Sequence: Synthetic oligonucleotide
  Target: SOD1; (-) strand; PAM type: NRG; PAM sequence: TAG
cagtgacacttcctggagtg

SEQ ID NO: 8756 - DNA, 20 bp, Artificial Sequence
  Description of Artificial Sequence: Synthetic oligonucleotide
  Target: SOD1; (-) strand; PAM type: NRG; PAM sequence: GAG
tgtgacagtgacacttcctg

SEQ ID NO: 8757 - DNA, 20 bp, Artificial Sequence
  Description of Artificial Sequence: Synthetic oligonucleotide
  Target: SOD1; (-) strand; PAM type: NRG; PAM sequence: TGG
aatgtgacagtgacacttcc

SEQ ID NO: 8758 - DNA, 20 bp, Artificial Sequence
  Description of Artificial Sequence: Synthetic oligonucleotide
  Target: SOD1; (-) strand; PAM type: NRG; PAM sequence: CAG
tggaatttgtgaaaatgtga

SEQ ID NO: 8759 - DNA, 20 bp, Artificial Sequence
  Description of Artificial Sequence: Synthetic oligonucleotide
  Target: SOD1; (-) strand; PAM type: NRG; PAM sequence: TGG
agaggctcctcgttagagac

SEQ ID NO: 8760 - DNA, 20 bp, Artificial Sequence
  Description of Artificial Sequence: Synthetic oligonucleotide
  Target: SOD1; (-) strand; PAM type: NRG; PAM sequence: GAG
gcagcagaggctcctcgtta

SEQ ID NO: 8761 - DNA, 20 bp, Artificial Sequence
  Description of Artificial Sequence: Synthetic oligonucleotide
  Target: SOD1; (-) strand; PAM type: NRG; PAM sequence: TAG
cagcagcagaggctcctcgt

SEQ ID NO: 8762 - DNA, 20 bp, Artificial Sequence
  Description of Artificial Sequence: Synthetic oligonucleotide
  Target: SOD1; (-) strand; PAM type: NRG; PAM sequence: AGG
ggattctggctcagcagcag

SEQ ID NO: 8763 - DNA, 20 bp, Artificial Sequence
  Description of Artificial Sequence: Synthetic oligonucleotide
  Target: SOD1; (-) strand; PAM type: NRG; PAM sequence: GAG
aggattctggctcagcagca

SEQ ID NO: 8764 - DNA, 20 bp, Artificial Sequence
  Description of Artificial Sequence: Synthetic oligonucleotide
  Target: SOD1; (-) strand; PAM type: NRG; PAM sequence: CAG
aaaggattctggctcagcag

SEQ ID NO: 8765 - DNA, 20 bp, Artificial Sequence
  Description of Artificial Sequence: Synthetic oligonucleotide
  Target: SOD1; (-) strand; PAM type: NRG; PAM sequence: CAG
cgaaaaggattctggctcag

SEQ ID NO: 8766 - DNA, 20 bp, Artificial Sequence
  Description of Artificial Sequence: Synthetic oligonucleotide
  Target: SOD1; (-) strand; PAM type: NRG; PAM sequence: CAG
acccgaaaaggattctggct

SEQ ID NO: 8767 - DNA, 20 bp, Artificial Sequence
  Description of Artificial Sequence: Synthetic oligonucleotide
  Target: SOD1; (-) strand; PAM type: NRG; PAM sequence: TGG
gttgaacccgaaaaggattc

SEQ ID NO: 8768 - DNA, 20 bp, Artificial Sequence
  Description of Artificial Sequence: Synthetic oligonucleotide
  Target: SOD1; (-) strand; PAM type: NRG; PAM sequence: AGG
ctcatccgttgaacccgaaa

SEQ ID NO: 8769 - DNA, 20 bp, Artificial Sequence
  Description of Artificial Sequence: Synthetic oligonucleotide
  Target: SOD1; (-) strand; PAM type: NRG; PAM sequence: AAG
cctcatccgttgaacccgaa

SEQ ID NO: 8770 - DNA, 20 bp, Artificial Sequence
  Description of Artificial Sequence: Synthetic oligonucleotide
  Target: SOD1; (-) strand; PAM type: NRG; PAM sequence: AGG
ttctgaagagttacctgctg

SEQ ID NO: 8771 - DNA, 20 bp, Artificial Sequence
  Description of Artificial Sequence: Synthetic oligonucleotide
  Target: SOD1; (-) strand; PAM type: NRG; PAM sequence: GAG
cttctgaagagttacctgct

SEQ ID NO: 8772 - DNA, 20 bp, Artificial Sequence
  Description of Artificial Sequence: Synthetic oligonucleotide
  Target: SOD1; (-) strand; PAM type: NRG; PAM sequence: GAG
cagtcctaaagccttctgaa

SEQ ID NO: 8773 - DNA, 20 bp, Artificial Sequence
  Description of Artificial Sequence: Synthetic oligonucleotide
  Target: SOD1; (-) strand; PAM type: NRG; PAM sequence: AAG
tgcagtcctaaagccttctg

SEQ ID NO: 8774 - DNA, 20 bp, Artificial Sequence
  Description of Artificial Sequence: Synthetic oligonucleotide
  Target: SOD1; (-) strand; PAM type: NRG; PAM sequence: AAG
tgtctgaggctgcagtccta

SEQ ID NO: 8775 - DNA, 20 bp, Artificial Sequence
  Description of Artificial Sequence: Synthetic oligonucleotide
  Target: SOD1; (-) strand; PAM type: NRG; PAM sequence: CAG
gaagggggtgtctgaggctg

SEQ ID NO: 8776 - DNA, 20 bp, Artificial Sequence
  Description of Artificial Sequence: Synthetic oligonucleotide
  Target: SOD1; (-) strand; PAM type: NRG; PAM sequence: AGG
acttgagaagggggtgtctg

SEQ ID NO: 8777 - DNA, 20 bp, Artificial Sequence
  Description of Artificial Sequence: Synthetic oligonucleotide
  Target: SOD1; (-) strand; PAM type: NRG; PAM sequence: GAG
aacttgagaagggggtgtct

SEQ ID NO: 8778 - DNA, 20 bp, Artificial Sequence
  Description of Artificial Sequence: Synthetic oligonucleotide
  Target: SOD1; (-) strand; PAM type: NRG; PAM sequence: GGG
tgcttcagaacttgagaagg

SEQ ID NO: 8779 - DNA, 20 bp, Artificial Sequence
  Description of Artificial Sequence: Synthetic oligonucleotide
  Target: SOD1; (-) strand; PAM type: NRG; PAM sequence: GGG
ctgcttcagaacttgagaag

SEQ ID NO: 8780 - DNA, 20 bp, Artificial Sequence
  Description of Artificial Sequence: Synthetic oligonucleotide
  Target: SOD1; (-) strand; PAM type: NRG; PAM sequence: GGG
actgcttcagaacttgagaa

SEQ ID NO: 8781 - DNA, 20 bp, Artificial Sequence
  Description of Artificial Sequence: Synthetic oligonucleotide
  Target: SOD1; (-) strand; PAM type: NRG; PAM sequence: AGG
cactgcttcagaacttgaga

SEQ ID NO: 8782 - DNA, 20 bp, Artificial Sequence
  Description of Artificial Sequence: Synthetic oligonucleotide
  Target: SOD1; (-) strand; PAM type: NRG; PAM sequence: AAG
acactgcttcagaacttgag

SEQ ID NO: 8783 - DNA, 20 bp, Artificial Sequence
  Description of Artificial Sequence: Synthetic oligonucleotide
  Target: SOD1; (-) strand; PAM type: NRG; PAM sequence: GAG
tagacactgcttcagaactt

SEQ ID NO: 8784 - DNA, 20 bp, Artificial Sequence
  Description of Artificial Sequence: Synthetic oligonucleotide
  Target: SOD1; (-) strand; PAM type: NRG; PAM sequence: CAG
gggaaatgtagacactgctt

SEQ ID NO: 8785 - DNA, 20 bp, Artificial Sequence
  Description of Artificial Sequence: Synthetic oligonucleotide
  Target: SOD1; (-) strand; PAM type: NRG; PAM sequence: TAG
cattagccaagtgggaaatg

SEQ ID NO: 8786 - DNA, 20 bp, Artificial Sequence
  Description of Artificial Sequence: Synthetic oligonucleotide
  Target: SOD1; (-) strand; PAM type: NRG; PAM sequence: GGG
gaacctcccattagccaagt

SEQ ID NO: 8787 - DNA, 20 bp, Artificial Sequence
  Description of Artificial Sequence: Synthetic oligonucleotide
  Target: SOD1; (-) strand; PAM type: NRG; PAM sequence: TGG
tgaacctcccattagccaag

SEQ ID NO: 8788 - DNA, 20 bp, Artificial Sequence
  Description of Artificial Sequence: Synthetic oligonucleotide
  Target: SOD1; (-) strand; PAM type: NRG; PAM sequence: AAG
cgttgaacctcccattagcc

SEQ ID NO: 8789 - DNA, 20 bp, Artificial Sequence
  Description of Artificial Sequence: Synthetic oligonucleotide
  Target: SOD1; (-) strand; PAM type: NRG; PAM sequence: TAG
aaaaccgttgaacctcccat

SEQ ID NO: 8790 - DNA, 20 bp, Artificial Sequence
  Description of Artificial Sequence: Synthetic oligonucleotide
  Target: SOD1; (-) strand; PAM type: NRG; PAM sequence: TGG
gaggtgacagacagggcagg

SEQ ID NO: 8791 - DNA, 20 bp, Artificial Sequence
  Description of Artificial Sequence: Synthetic oligonucleotide
  Target: SOD1; (-) strand; PAM type: NRG; PAM sequence: AGG
cctgaggtgacagacagggc

SEQ ID NO: 8792 - DNA, 20 bp, Artificial Sequence
  Description of Artificial Sequence: Synthetic oligonucleotide
  Target: SOD1; (-) strand; PAM type: NRG; PAM sequence: CAG
gcctgaggtgacagacaggg

SEQ ID NO: 8793 - DNA, 20 bp, Artificial Sequence
  Description of Artificial Sequence: Synthetic oligonucleotide
  Target: SOD1; (-) strand; PAM type: NRG; PAM sequence: GGG
aaagcctgaggtgacagaca

SEQ ID NO: 8794 - DNA, 20 bp, Artificial Sequence
  Description of Artificial Sequence: Synthetic oligonucleotide
  Target: SOD1; (-) strand; PAM type: NRG; PAM sequence: AGG
aaaagcctgaggtgacagac

SEQ ID NO: 8795 - DNA, 20 bp, Artificial Sequence
  Description of Artificial Sequence: Synthetic oligonucleotide
  Target: SOD1; (-) strand; PAM type: NRG; PAM sequence: CAG
gaaaagcctgaggtgacaga

SEQ ID NO: 8796 - DNA, 20 bp, Artificial Sequence
  Description of Artificial Sequence: Synthetic oligonucleotide
  Target: SOD1; (-) strand; PAM type: NRG; PAM sequence: CAG
aaaggaaaagcctgaggtga

SEQ ID NO: 8797 - DNA, 20 bp, Artificial Sequence
  Description of Artificial Sequence: Synthetic oligonucleotide
  Target: SOD1; (-) strand; PAM type: NRG; PAM sequence: AGG
ccgaggaaaggaaaagcctg

SEQ ID NO: 8798 - DNA, 20 bp, Artificial Sequence
  Description of Artificial Sequence: Synthetic oligonucleotide
  Target: SOD1; (-) strand; PAM type: NRG; PAM sequence: GAG
cccgaggaaaggaaaagcct

SEQ ID NO: 8799 - DNA, 20 bp, Artificial Sequence
  Description of Artificial Sequence: Synthetic oligonucleotide
  Target: SOD1; (-) strand; PAM type: NRG; PAM sequence: AAG
aagaagcccgaggaaaggaa

SEQ ID NO: 8800 - DNA, 20 bp, Artificial Sequence
  Description of Artificial Sequence: Synthetic oligonucleotide
  Target: SOD1; (-) strand; PAM type: NRG; PAM sequence: AGG
gaaggaagaagcccgaggaa

SEQ ID NO: 8801 - DNA, 20 bp, Artificial Sequence
  Description of Artificial Sequence: Synthetic oligonucleotide
  Target: SOD1; (-) strand; PAM type: NRG; PAM sequence: AAG
agaaggaagaagcccgagga

SEQ ID NO: 8802 - DNA, 20 bp, Artificial Sequence
  Description of Artificial Sequence: Synthetic oligonucleotide
  Target: SOD1; (-) strand; PAM type: NRG; PAM sequence: AGG
agagagaaggaagaagcccg

SEQ ID NO: 8803 - DNA, 20 bp, Artificial Sequence
  Description of Artificial Sequence: Synthetic oligonucleotide
  Target: SOD1; (-) strand; PAM type: NRG; PAM sequence: GAG
tagagagaaggaagaagccc

SEQ ID NO: 8804 - DNA, 20 bp, Artificial Sequence
  Description of Artificial Sequence: Synthetic oligonucleotide
  Target: SOD1; (-) strand; PAM type: NRG; PAM sequence: AAG
gtctcgtagagagaaggaag

SEQ ID NO: 8805 - DNA, 20 bp, Artificial Sequence
  Description of Artificial Sequence: Synthetic oligonucleotide
  Target: SOD1; (-) strand; PAM type: NRG; PAM sequence: AAG
agagtctcgtagagagaagg

SEQ ID NO: 8806 - DNA, 20 bp, Artificial Sequence
  Description of Artificial Sequence: Synthetic oligonucleotide
  Target: SOD1; (-) strand; PAM type: NRG; PAM sequence: AGG
tagagagtctcgtagagaga

SEQ ID NO: 8807 - DNA, 20 bp, Artificial Sequence
  Description of Artificial Sequence: Synthetic oligonucleotide
  Target: SOD1; (-) strand; PAM type: NRG; PAM sequence: AAG
atagagagtctcgtagagag

SEQ ID NO: 8808 - DNA, 20 bp, Artificial Sequence
  Description of Artificial Sequence: Synthetic oligonucleotide
  Target: SOD1; (-) strand; PAM type: NRG; PAM sequence: GAG
gagatagagagtctcgtaga

SEQ ID NO: 8809 - DNA, 20 bp, Artificial Sequence
  Description of Artificial Sequence: Synthetic oligonucleotide
  Target: SOD1; (-) strand; PAM type: NRG; PAM sequence: GAG
tagagatagagagtctcgta

SEQ ID NO: 8810 - DNA, 20 bp, Artificial Sequence
  Description of Artificial Sequence: Synthetic oligonucleotide
  Target: SOD1; (-) strand; PAM type: NRG; PAM sequence: TAG
tctagagatagagagtctcg

SEQ ID NO: 8811 - DNA, 20 bp, Artificial Sequence
  Description of Artificial Sequence: Synthetic oligonucleotide
  Target: SOD1; (-) strand; PAM type: NRG; PAM sequence: GAG
agagagattctagagataga

SEQ ID NO: 8812 - DNA, 20 bp, Artificial Sequence
  Description of Artificial Sequence: Synthetic oligonucleotide
  Target: SOD1; (-) strand; PAM type: NRG; PAM sequence: GAG
agagagagattctagagata

SEQ ID NO: 8813 - DNA, 20 bp, Artificial Sequence
  Description of Artificial Sequence: Synthetic oligonucleotide
  Target: SOD1; (-) strand; PAM type: NRG; PAM sequence: TAG
agagagagagattctagaga

SEQ ID NO: 8814 - DNA, 20 bp, Artificial Sequence
  Description of Artificial Sequence: Synthetic oligonucleotide
  Target: SOD1; (-) strand; PAM type: NRG; PAM sequence: GAG
agacagagagagagattcta

SEQ ID NO: 8815 - DNA, 20 bp, Artificial Sequence
  Description of Artificial Sequence: Synthetic oligonucleotide
  Target: SOD1; (-) strand; PAM type: NRG; PAM sequence: TAG
cgagacagagagagagattc

SEQ ID NO: 8816 - DNA, 20 bp, Artificial Sequence
  Description of Artificial Sequence: Synthetic oligonucleotide
  Target: SOD1; (-) strand; PAM type: NRG; PAM sequence: GAG
tgggcatcgagacagagaga

SEQ ID NO: 8817 - DNA, 20 bp, Artificial Sequence
  Description of Artificial Sequence: Synthetic oligonucleotide
  Target: SOD1; (-) strand; PAM type: NRG; PAM sequence: GAG
agtgggcatcgagacagaga

SEQ ID NO: 8818 - DNA, 20 bp, Artificial Sequence
  Description of Artificial Sequence: Synthetic oligonucleotide
  Target: SOD1; (-) strand; PAM type: NRG; PAM sequence: GAG
ctagtgggcatcgagacaga

SEQ ID NO: 8819 - DNA, 20 bp, Artificial Sequence
  Description of Artificial Sequence: Synthetic oligonucleotide
  Target: SOD1; (-) strand; PAM type: NRG; PAM sequence: GAG
ctctagtgggcatcgagaca

SEQ ID NO: 8820 - DNA, 20 bp, Artificial Sequence
  Description of Artificial Sequence: Synthetic oligonucleotide
  Target: SOD1; (-) strand; PAM type: NRG; PAM sequence: CAG
cgctctagtgggcatcgaga

SEQ ID NO: 8821 - DNA, 20 bp, Artificial Sequence
  Description of Artificial Sequence: Synthetic oligonucleotide
  Target: SOD1; (-) strand; PAM type: NRG; PAM sequence: GAG
tagacgctctagtgggcatc

SEQ ID NO: 8822 - DNA, 20 bp, Artificial Sequence
  Description of Artificial Sequence: Synthetic oligonucleotide
  Target: SOD1; (-) strand; PAM type: NRG; PAM sequence: GGG
agagaaatagacgctctagt

SEQ ID NO: 8823 - DNA, 20 bp, Artificial Sequence
  Description of Artificial Sequence: Synthetic oligonucleotide
  Target: SOD1; (-) strand; PAM type: NRG; PAM sequence: TGG
gagagaaatagacgctctag

SEQ ID NO: 8824 - DNA, 20 bp, Artificial Sequence
  Description of Artificial Sequence: Synthetic oligonucleotide
  Target: SOD1; (-) strand; PAM type: NRG; PAM sequence: TAG
gaagagagaaatagacgctc

SEQ ID NO: 8825 - DNA, 20 bp, Artificial Sequence
  Description of Artificial Sequence: Synthetic oligonucleotide
  Target: SOD1; (-) strand; PAM type: NRG; PAM sequence: TAG
agagacttggaagagagaaa

SEQ ID NO: 8826 - DNA, 20 bp, Artificial Sequence
  Description of Artificial Sequence: Synthetic oligonucleotide
  Target: SOD1; (-) strand; PAM type: NRG; PAM sequence: GAG
aggcacagagacttggaaga

SEQ ID NO: 8827 - DNA, 20 bp, Artificial Sequence
  Description of Artificial Sequence: Synthetic oligonucleotide
  Target: SOD1; (-) strand; PAM type: NRG; PAM sequence: GAG
acaggcacagagacttggaa

SEQ ID NO: 8828 - DNA, 20 bp, Artificial Sequence
  Description of Artificial Sequence: Synthetic oligonucleotide
  Target: SOD1; (-) strand; PAM type: NRG; PAM sequence: AAG
ggacaggcacagagacttgg

SEQ ID NO: 8829 - DNA, 20 bp, Artificial Sequence
  Description of Artificial Sequence: Synthetic oligonucleotide
  Target: SOD1; (-) strand; PAM type: NRG; PAM sequence: TGG
ccgggacaggcacagagact

SEQ ID NO: 8830 - DNA, 20 bp, Artificial Sequence
  Description of Artificial Sequence: Synthetic oligonucleotide
  Target: SOD1; (-) strand; PAM type: NRG; PAM sequence: GAG
ccctgaccgggacaggcaca

SEQ ID NO: 8831 - DNA, 20 bp, Artificial Sequence
  Description of Artificial Sequence: Synthetic oligonucleotide
  Target: SOD1; (-) strand; PAM type: NRG; PAM sequence: CAG
agccctgaccgggacaggca

SEQ ID NO: 8832 - DNA, 20 bp, Artificial Sequence
  Description of Artificial Sequence: Synthetic oligonucleotide
  Target: SOD1; (-) strand; PAM type: NRG; PAM sequence: AGG
ggaggagccctgaccgggac

SEQ ID NO: 8833 - DNA, 20 bp, Artificial Sequence
  Description of Artificial Sequence: Synthetic oligonucleotide
  Target: SOD1; (-) strand; PAM type: NRG; PAM sequence: CAG
aggaggagccctgaccggga

SEQ ID NO: 8834 - DNA, 20 bp, Artificial Sequence
  Description of Artificial Sequence: Synthetic oligonucleotide
  Target: SOD1; (-) strand; PAM type: NRG; PAM sequence: GGG
gggaaggaggagccctgacc

SEQ ID NO: 8835 - DNA, 20 bp, Artificial Sequence
  Description of Artificial Sequence: Synthetic oligonucleotide
  Target: SOD1; (-) strand; PAM type: NRG; PAM sequence: CGG
ggggaaggaggagccctgac

SEQ ID NO: 8836 - DNA, 20 bp, Artificial Sequence
  Description of Artificial Sequence: Synthetic oligonucleotide
  Target: SOD1; (-) strand; PAM type: NRG; PAM sequence: GAG
aggagagagtggggaaggag

SEQ ID NO: 8837 - DNA, 20 bp, Artificial Sequence
  Description of Artificial Sequence: Synthetic oligonucleotide
  Target: SOD1; (-) strand; PAM type: NRG; PAM sequence: AGG
acaggagagagtggggaagg

SEQ ID NO: 8838 - DNA, 20 bp, Artificial Sequence
  Description of Artificial Sequence: Synthetic oligonucleotide
  Target: SOD1; (-) strand; PAM type: NRG; PAM sequence: GAG
gacaggagagagtggggaag

SEQ ID NO: 8839 - DNA, 20 bp, Artificial Sequence
  Description of Artificial Sequence: Synthetic oligonucleotide
  Target: SOD1; (-) strand; PAM type: NRG; PAM sequence: AGG
gtgacaggagagagtgggga

SEQ ID NO: 8840 - DNA, 20 bp, Artificial Sequence
  Description of Artificial Sequence: Synthetic oligonucleotide
  Target: SOD1; (-) strand; PAM type: NRG; PAM sequence: AAG
cgtgacaggagagagtgggg

SEQ ID NO: 8841 - DNA, 20 bp, Artificial Sequence
  Description of Artificial Sequence: Synthetic oligonucleotide
  Target: SOD1; (-) strand; PAM type: NRG; PAM sequence: GGG
aaccgtgacaggagagagtg

SEQ ID NO: 8842 - DNA, 20 bp, Artificial Sequence
  Description of Artificial Sequence: Synthetic oligonucleotide
  Target: SOD1; (-) strand; PAM type: NRG; PAM sequence: GGG
taaccgtgacaggagagagt

SEQ ID NO: 8843 - DNA, 20 bp, Artificial Sequence
  Description of Artificial Sequence: Synthetic oligonucleotide
  Target: SOD1; (-) strand; PAM type: NRG; PAM sequence: TGG
gtaaccgtgacaggagagag

SEQ ID NO: 8844 - DNA, 20 bp, Artificial Sequence
  Description of Artificial Sequence: Synthetic oligonucleotide
  Target: SOD1; (-) strand; PAM type: NRG; PAM sequence: GAG
atagtaaccgtgacaggaga

SEQ ID NO: 8845 - DNA, 20 bp, Artificial Sequence
  Description of Artificial Sequence: Synthetic oligonucleotide
  Target: SOD1; (-) strand; PAM type: NRG; PAM sequence: GAG
taatagtaaccgtgacagga

SEQ ID NO: 8846 - DNA, 20 bp, Artificial Sequence
  Description of Artificial Sequence: Synthetic oligonucleotide
  Target: SOD1; (-) strand; PAM type: NRG; PAM sequence: GAG
gataatagtaaccgtgacag

SEQ ID NO: 8847 - DNA, 20 bp, Artificial Sequence
  Description of Artificial Sequence: Synthetic oligonucleotide
  Target: SOD1; (-) strand; PAM type: NRG; PAM sequence: AGG
gagataatagtaaccgtgac

SEQ ID NO: 8848 - DNA, 20 bp, Artificial Sequence
  Description of Artificial Sequence: Synthetic oligonucleotide
  Target: SOD1; (-) strand; PAM type: NRG; PAM sequence: CAG
agagataatagtaaccgtga

SEQ ID NO: 8849 - DNA, 20 bp, Artificial Sequence
  Description of Artificial Sequence: Synthetic oligonucleotide
  Target: SOD1; (-) strand; PAM type: NRG; PAM sequence: TAG
cgtaatgatgatagagataa

SEQ ID NO: 8850 - DNA, 20 bp, Artificial Sequence
  Description of Artificial Sequence: Synthetic oligonucleotide
  Target: SOD1; (-) strand; PAM type: NRG; PAM sequence: GAG
tgggaaccgtaatgatgata

SEQ ID NO: 8851 - DNA, 20 bp, Artificial Sequence
  Description of Artificial Sequence: Synthetic oligonucleotide
  Target: SOD1; (-) strand; PAM type: NRG; PAM sequence: TAG
tatgggaaccgtaatgatga

SEQ ID NO: 8852 - DNA, 20 bp, Artificial Sequence
  Description of Artificial Sequence: Synthetic oligonucleotide
  Target: SOD1; (-) strand; PAM type: NRG; PAM sequence: GGG
aaaatgaccgggaacggtat

SEQ ID NO: 8853 - DNA, 20 bp, Artificial Sequence
  Description of Artificial Sequence: Synthetic oligonucleotide
  Target: SOD1; (-) strand; PAM type: NRG; PAM sequence: TGG
gaaaatgaccgggaacggta

SEQ ID NO: 8854 - DNA, 20 bp, Artificial Sequence
  Description of Artificial Sequence: Synthetic oligonucleotide
  Target: SOD1; (-) strand; PAM type: NRG; PAM sequence: CGG
gggtggaaaatgaccgggaa

SEQ ID NO: 8855 - DNA, 20 bp, Artificial Sequence
  Description of Artificial Sequence: Synthetic oligonucleotide
  Target: SOD1; (-) strand; PAM type: NRG; PAM sequence: GGG
aaatagggtggaaaatgacc

SEQ ID NO: 8856 - DNA, 20 bp, Artificial Sequence
  Description of Artificial Sequence: Synthetic oligonucleotide
  Target: SOD1; (-) strand; PAM type: NRG; PAM sequence: CGG
gaaatagggtggaaaatgac

SEQ ID NO: 8857 - DNA, 20 bp, Artificial Sequence
  Description of Artificial Sequence: Synthetic oligonucleotide
  Target: SOD1; (-) strand; PAM type: NRG; PAM sequence: TGG
aagatcttttggaaataggg

SEQ ID NO: 8858 - DNA, 20 bp, Artificial Sequence
  Description of Artificial Sequence: Synthetic oligonucleotide
  Target: SOD1; (-) strand; PAM type: NRG; PAM sequence: GGG
aagaagatcttttggaaata

SEQ ID NO: 8859 - DNA, 20 bp, Artificial Sequence
  Description of Artificial Sequence: Synthetic oligonucleotide
  Target: SOD1; (-) strand; PAM type: NRG; PAM sequence: AGG
gaagaagatcttttggaaat

SEQ ID NO: 8860 - DNA, 20 bp, Artificial Sequence
  Description of Artificial Sequence: Synthetic oligonucleotide
  Target: SOD1; (-) strand; PAM type: NRG; PAM sequence: TAG
ggaagaagatcttttggaaa

SEQ ID NO: 8861 - DNA, 20 bp, Artificial Sequence
  Description of Artificial Sequence: Synthetic oligonucleotide
  Target: SOD1; (-) strand; PAM type: NRG; PAM sequence: TGG
aggtttggaagaagatcttt

SEQ ID NO: 8862 - DNA, 20 bp, Artificial Sequence
  Description of Artificial Sequence: Synthetic oligonucleotide
  Target: SOD1; (-) strand; PAM type: NRG; PAM sequence: AAG
gaccaagaaaggtttggaag

SEQ ID NO: 8863 - DNA, 20 bp, Artificial Sequence
  Description of Artificial Sequence: Synthetic oligonucleotide
  Target: SOD1; (-) strand; PAM type: NRG; PAM sequence: AAG
agagaccaagaaaggtttgg

SEQ ID NO: 8864 - DNA, 20 bp, Artificial Sequence
  Description of Artificial Sequence: Synthetic oligonucleotide
  Target: SOD1; (-) strand; PAM type: NRG; PAM sequence: TGG
ggtagagaccaagaaaggtt

SEQ ID NO: 8865 - DNA, 20 bp, Artificial Sequence
  Description of Artificial Sequence: Synthetic oligonucleotide
  Target: SOD1; (-) strand; PAM type: NRG; PAM sequence: AGG
attcaggtagagaccaagaa

SEQ ID NO: 8866 - DNA, 20 bp, Artificial Sequence
  Description of Artificial Sequence: Synthetic oligonucleotide
  Target: SOD1; (-) strand; PAM type: NRG; PAM sequence: AAG
aattcaggtagagaccaaga

SEQ ID NO: 8867 - DNA, 20 bp, Artificial Sequence
  Description of Artificial Sequence: Synthetic oligonucleotide
  Target: SOD1; (-) strand; PAM type: NRG; PAM sequence: AAG
gttcaattcaggtagagacc

SEQ ID NO: 8868 - DNA, 20 bp, Artificial Sequence
  Description of Artificial Sequence: Synthetic oligonucleotide
  Target: SOD1; (-) strand; PAM type: NRG; PAM sequence: GAG
gcagcagttcaattcaggta

SEQ ID NO: 8869 - DNA, 20 bp, Artificial Sequence
  Description of Artificial Sequence: Synthetic oligonucleotide
  Target: SOD1; (-) strand; PAM type: NRG; PAM sequence: TAG
aggcagcagttcaattcagg

SEQ ID NO: 8870 - DNA, 20 bp, Artificial Sequence
  Description of Artificial Sequence: Synthetic oligonucleotide
  Target: SOD1; (-) strand; PAM type: NRG; PAM sequence: AGG
aacaggcagcagttcaattc

SEQ ID NO: 8871 - DNA, 20 bp, Artificial Sequence
  Description of Artificial Sequence: Synthetic oligonucleotide
  Target: SOD1; (-) strand; PAM type: NRG; PAM sequence: CAG
taacaggcagcagttcaatt

SEQ ID NO: 8872 - DNA, 20 bp, Artificial Sequence
  Description of Artificial Sequence: Synthetic oligonucleotide
  Target: SOD1; (-) strand; PAM type: NRG; PAM sequence: CAG
ttagaaatgataacaggcag

SEQ ID NO: 8873 - DNA, 20 bp, Artificial Sequence
  Description of Artificial Sequence: Synthetic oligonucleotide
  Target: SOD1; (-) strand; PAM type: NRG; PAM sequence: CAG
agtttagaaatgataacagg

SEQ ID NO: 8874 - DNA, 20 bp, Artificial Sequence
  Description of Artificial Sequence: Synthetic oligonucleotide
  Target: SOD1; (-) strand; PAM type: NRG; PAM sequence: AGG
agcagtttagaaatgataac

SEQ ID NO: 8875 - DNA, 20 bp, Artificial Sequence
  Description of Artificial Sequence: Synthetic oligonucleotide
  Target: SOD1; (-) strand; PAM type: NRG; PAM sequence: CAG
cagcagtttagaaatgataa

SEQ ID NO: 8876 - DNA, 20 bp, Artificial Sequence
  Description of Artificial Sequence: Synthetic oligonucleotide
  Target: SOD1; (-) strand; PAM type: NRG; PAM sequence: TAG
cagcagcagccacagcagtt

SEQ ID NO: 8877 - DNA, 20 bp, Artificial Sequence
  Description of Artificial Sequence: Synthetic oligonucleotide
  Target: SOD1; (-) strand; PAM type: NRG; PAM sequence: CAG
caacacagcagcagccacag

SEQ ID NO: 8878 - DNA, 20 bp, Artificial Sequence
  Description of Artificial Sequence: Synthetic oligonucleotide
  Target: SOD1; (-) strand; PAM type: NRG; PAM sequence: CAG
caccaacacagcagcagcca

SEQ ID NO: 8879 - DNA, 20 bp, Artificial Sequence
  Description of Artificial Sequence: Synthetic oligonucleotide
  Target: SOD1; (-) strand; PAM type: NRG; PAM sequence: CAG
agcctccaccaacacagcag

SEQ ID NO: 8880 - DNA, 20 bp, Artificial Sequence
  Description of Artificial Sequence: Synthetic oligonucleotide
  Target: SOD1; (-) strand; PAM type: NRG; PAM sequence: CAG
aacagcctccaccaacacag

SEQ ID NO: 8881 - DNA, 20 bp, Artificial Sequence
  Description of Artificial Sequence: Synthetic oligonucleotide
  Target: SOD1; (-) strand; PAM type: NRG; PAM sequence: CAG
cacaacagcctccaccaaca

SEQ ID NO: 8882 - DNA, 20 bp, Artificial Sequence
  Description of Artificial Sequence: Synthetic oligonucleotide
  Target: SOD1; (-) strand; PAM type: NRG; PAM sequence: CAG
agcagccaccaccatcacaa

SEQ ID NO: 8883 - DNA, 20 bp, Artificial Sequence
  Description of Artificial Sequence: Synthetic oligonucleotide
  Target: SOD1; (-) strand; PAM type: NRG; PAM sequence: CAG
cacagcagcagcagcagcag

SEQ ID NO: 8884 - DNA, 20 bp, Artificial Sequence
  Description of Artificial Sequence: Synthetic oligonucleotide
  Target: SOD1; (-) strand; PAM type: NRG; PAM sequence: CAG
aaccacagcagcagcagcag

SEQ ID NO: 8885 - DNA, 20 bp, Artificial Sequence
  Description of Artificial Sequence: Synthetic oligonucleotide
  Target: SOD1; (-) strand; PAM type: NRG; PAM sequence: CAG
agcaaccacagcagcagcag

SEQ ID NO: 8886 - DNA, 20 bp, Artificial Sequence
  Description of Artificial Sequence: Synthetic oligonucleotide
  Target: SOD1; (-) strand; PAM type: NRG; PAM sequence: CAG
cccagcaaccacagcagcag

SEQ ID NO: 8887 - DNA, 20 bp, Artificial Sequence
  Description of Artificial Sequence: Synthetic oligonucleotide
  Target: SOD1; (-) strand; PAM type: NRG; PAM sequence: CAG
cgccccagcaaccacagcag

SEQ ID NO: 8888 - DNA, 20 bp, Artificial Sequence
  Description of Artificial Sequence: Synthetic oligonucleotide
  Target: SOD1; (-) strand; PAM type: NRG; PAM sequence: CAG
aggcgccccagcaaccacag

SEQ ID NO: 8889 - DNA, 20 bp, Artificial Sequence
  Description of Artificial Sequence: Synthetic oligonucleotide
  Target: SOD1; (-) strand; PAM type: NRG; PAM sequence: CAG
cgcaggcgccccagcaacca

SEQ ID NO: 8890 - DNA, 20 bp, Artificial Sequence
  Description of Artificial Sequence: Synthetic oligonucleotide
  Target: SOD1; (-) strand; PAM type: NRG; PAM sequence: CAG
agccacagccgcaggcgccc

SEQ ID NO: 8891 - DNA, 20 bp, Artificial Sequence
  Description of Artificial Sequence: Synthetic oligonucleotide
  Target: SOD1; (-) strand; PAM type: NRG; PAM sequence: AGG
acagcagcagccacagccgc

SEQ ID NO: 8892 - DNA, 20 bp, Artificial Sequence
  Description of Artificial Sequence: Synthetic oligonucleotide
  Target: SOD1; (-) strand; PAM type: NRG; PAM sequence: CAG
cacagcagcagccacagccg

SEQ ID NO: 8893 - DNA, 20 bp, Artificial Sequence
  Description of Artificial Sequence: Synthetic oligonucleotide
  Target: SOD1; (-) strand; PAM type: NRG; PAM sequence: CAG
agcagccacagcagcagcca

SEQ ID NO: 8894 - DNA, 20 bp, Artificial Sequence
  Description of Artificial Sequence: Synthetic oligonucleotide
  Target: SOD1; (-) strand; PAM type: NRG; PAM sequence: CAG
cgccgcagcagccacagcag

SEQ ID NO: 8895 - DNA, 20 bp, Artificial Sequence
  Description of Artificial Sequence: Synthetic oligonucleotide
  Target: SOD1; (-) strand; PAM type: NRG; PAM sequence: CAG
agccgccgcagcagccacag

SEQ ID NO: 8896 - DNA, 20 bp, Artificial Sequence
  Description of Artificial Sequence: Synthetic oligonucleotide
  Target: SOD1; (-) strand; PAM type: NRG; PAM sequence: CAG
aacagccgccgcagcagcca

SEQ ID NO: 8897 - DNA, 20 bp, Artificial Sequence
  Description of Artificial Sequence: Synthetic oligonucleotide
  Target: SOD1; (-) strand; PAM type: NRG; PAM sequence: CAG
gaaggcaacagccgccgcag

SEQ ID NO: 8898 - DNA, 20 bp, Artificial Sequence
  Description of Artificial Sequence: Synthetic oligonucleotide
  Target: SOD1; (-) strand; PAM type: NRG; PAM sequence: CAG
acggaaggcaacagccgccg

SEQ ID NO: 8899 - DNA, 20 bp, Artificial Sequence
  Description of Artificial Sequence: Synthetic oligonucleotide
  Target: SOD1; (-) strand; PAM type: NRG; PAM sequence: CAG
aagacagagacggaaggcaa

SEQ ID NO: 8900 - DNA, 20 bp, Artificial Sequence
  Description of Artificial Sequence: Synthetic oligonucleotide
  Target: SOD1; (-) strand; PAM type: NRG; PAM sequence: AGG
gtcctgaagacagagacgga

SEQ ID NO: 8901 - DNA, 20 bp, Artificial Sequence
  Description of Artificial Sequence: Synthetic oligonucleotide
  Target: SOD1; (-) strand; PAM type: NRG; PAM sequence: AAG
ggtcctgaagacagagacgg

SEQ ID NO: 8902 - DNA, 20 bp, Artificial Sequence
  Description of Artificial Sequence: Synthetic oligonucleotide
  Target: SOD1; (-) strand; PAM type: NRG; PAM sequence: CGG
gggggtcctgaagacagaga

SEQ ID NO: 8903 - DNA, 20 bp, Artificial Sequence
  Description of Artificial Sequence: Synthetic oligonucleotide
  Target: SOD1; (-) strand; PAM type: NRG; PAM sequence: GAG
cccagggggtcctgaagaca

SEQ ID NO: 8904 - DNA, 20 bp, Artificial Sequence
  Description of Artificial Sequence: Synthetic oligonucleotide
  Target: SOD1; (-) strand; PAM type: NRG; PAM sequence: CAG
ggcccagggggtcctgaaga

SEQ ID NO: 8905 - DNA, 20 bp, Artificial Sequence
  Description of Artificial Sequence: Synthetic oligonucleotide
  Target: SOD1; (-) strand; PAM type: NRG; PAM sequence: AAG
gccaggcccagggggtcctg

SEQ ID NO: 8906 - DNA, 20 bp, Artificial Sequence
  Description of Artificial Sequence: Synthetic oligonucleotide
  Target: SOD1; (-) strand; PAM type: NRG; PAM sequence: GGG
ggcccagggccaggcccagg

SEQ ID NO: 8907 - DNA, 20 bp, Artificial Sequence
  Description of Artificial Sequence: Synthetic oligonucleotide
  Target: SOD1; (-) strand; PAM type: NRG; PAM sequence: GGG
gggcccagggccaggcccag

SEQ ID NO: 8908 - DNA, 20 bp, Artificial Sequence
  Description of Artificial Sequence: Synthetic oligonucleotide
  Target: SOD1; (-) strand; PAM type: NRG; PAM sequence: GGG
ggggcccagggccaggccca

SEQ ID NO: 8909 - DNA, 20 bp, Artificial Sequence
  Description of Artificial Sequence: Synthetic oligonucleotide
  Target: SOD1; (-) strand; PAM type: NRG; PAM sequence: AGG
gggggcccagggccaggccc

SEQ ID NO: 8910 - DNA, 20 bp, Artificial Sequence
  Description of Artificial Sequence: Synthetic oligonucleotide
  Target: SOD1; (-) strand; PAM type: NRG; PAM sequence: CAG
cgggggcccagggccaggcc

SEQ ID NO: 8911 - DNA, 20 bp, Artificial Sequence
  Description of Artificial Sequence: Synthetic oligonucleotide
  Target: SOD1; (-) strand; PAM type: NRG; PAM sequence: AGG
gggctcgggggcccagggcc

SEQ ID NO: 8912 - DNA, 20 bp, Artificial Sequence
  Description of Artificial Sequence: Synthetic oligonucleotide
  Target: SOD1; (-) strand; PAM type: NRG; PAM sequence: CAG
agggctcgggggcccagggc

SEQ ID NO: 8913 - DNA, 20 bp, Artificial Sequence
  Description of Artificial Sequence: Synthetic oligonucleotide
  Target: SOD1; (-) strand; PAM type: NRG; PAM sequence: GGG
tgccagggctcgggggccca

SEQ ID NO: 8914 - DNA, 20 bp, Artificial Sequence
  Description of Artificial Sequence: Synthetic oligonucleotide
  Target: SOD1; (-) strand; PAM type: NRG; PAM sequence: AGG
atgccagggctcgggggccc

SEQ ID NO: 8915 - DNA, 20 bp, Artificial Sequence
  Description of Artificial Sequence: Synthetic oligonucleotide
  Target: SOD1; (-) strand; PAM type: NRG; PAM sequence: CAG
aatgccagggctcgggggcc

SEQ ID NO: 8916 - DNA, 20 bp, Artificial Sequence
  Description of Artificial Sequence: Synthetic oligonucleotide
  Target: SOD1; (-) strand; PAM type: NRG; PAM sequence: GGG
ggtggaatgccagggctcgg

SEQ ID NO: 8917 - DNA, 20 bp, Artificial Sequence
  Description of Artificial Sequence: Synthetic oligonucleotide
  Target: SOD1; (-) strand; PAM type: NRG; PAM sequence: GGG
tggtggaatgccagggctcg

SEQ ID NO: 8918 - DNA, 20 bp, Artificial Sequence
  Description of Artificial Sequence: Synthetic oligonucleotide
  Target: SOD1; (-) strand; PAM type: NRG; PAM sequence: GGG
ctggtggaatgccagggctc

SEQ ID NO: 8919 - DNA, 20 bp, Artificial Sequence
  Description of Artificial Sequence: Synthetic oligonucleotide
  Target: SOD1; (-) strand; PAM type: NRG; PAM sequence: CGG
cctggtggaatgccagggct

SEQ ID NO: 8920 - DNA, 20 bp, Artificial Sequence
  Description of Artificial Sequence: Synthetic oligonucleotide
  Target: SOD1; (-) strand; PAM type: NRG; PAM sequence: GGG
ttaggcctggtggaatgcca

SEQ ID NO: 8921 - DNA, 20 bp, Artificial Sequence
  Description of Artificial Sequence: Synthetic oligonucleotide
  Target: SOD1; (-) strand; PAM type: NRG; PAM sequence: AGG
gttaggcctggtggaatgcc

SEQ ID NO: 8922 - DNA, 20 bp, Artificial Sequence
  Description of Artificial Sequence: Synthetic oligonucleotide
  Target: SOD1; (-) strand; PAM type: NRG; PAM sequence: CAG
tgttaggcctggtggaatgc

SEQ ID NO: 8923 - DNA, 20 bp, Artificial Sequence
  Description of Artificial Sequence: Synthetic oligonucleotide
  Target: SOD1; (-) strand; PAM type: NRG; PAM sequence: TGG
ggcccctttgttaggcctgg

SEQ ID NO: 8924 - DNA, 20 bp, Artificial Sequence
  Description of Artificial Sequence: Synthetic oligonucleotide
  Target: SOD1; (-) strand; PAM type: NRG; PAM sequence: TGG
catggcccctttgttaggcc

SEQ ID NO: 8925 - DNA, 20 bp, Artificial Sequence
  Description of Artificial Sequence: Synthetic oligonucleotide
  Target: SOD1; (-) strand; PAM type: NRG; PAM sequence: AGG
caccgcatggcccctttgtt

SEQ ID NO: 8926 - DNA, 20 bp, Artificial Sequence
  Description of Artificial Sequence: Synthetic oligonucleotide
  Target: SOD1; (-) strand; PAM type: NRG; PAM sequence: TAG
ccaccgcatggcccctttgt

SEQ ID NO: 8927 - DNA, 20 bp, Artificial Sequence
  Description of Artificial Sequence: Synthetic oligonucleotide
  Target: SOD1; (-) strand; PAM type: NRG; PAM sequence: TGG
aaaggtcccttcccaccgca

SEQ ID NO: 8928 - DNA, 20 bp, Artificial Sequence
  Description of Artificial Sequence: Synthetic oligonucleotide
  Target: SOD1; (-) strand; PAM type: NRG; PAM sequence: AGG
cctccacctcatggaatgaa

SEQ ID NO: 8929 - DNA, 20 bp, Artificial Sequence
  Description of Artificial Sequence: Synthetic oligonucleotide
  Target: SOD1; (-) strand; PAM type: NRG; PAM sequence: AAG
gcctccacctcatggaatga

SEQ ID NO: 8930 - DNA, 20 bp, Artificial Sequence
  Description of Artificial Sequence: Synthetic oligonucleotide
  Target: SOD1; (-) strand; PAM type: NRG; PAM sequence: TGG
tttgcgatgcctccacctca

SEQ ID NO: 8931 - DNA, 20 bp, Artificial Sequence
  Description of Artificial Sequence: Synthetic oligonucleotide
  Target: SOD1; (-) strand; PAM type: NRG; PAM sequence: GGG
ggcccaccgccaggaccagg

SEQ ID NO: 8932 - DNA, 20 bp, Artificial Sequence
  Description of Artificial Sequence: Synthetic oligonucleotide
  Target: SOD1; (-) strand; PAM type: NRG; PAM sequence: GGG
aggcccaccgccaggaccag

SEQ ID NO: 8933 - DNA, 20 bp, Artificial Sequence
  Description of Artificial Sequence: Synthetic oligonucleotide
  Target: SOD1; (-) strand; PAM type: NRG; PAM sequence: GGG
gaggcccaccgccaggacca

SEQ ID NO: 8934 - DNA, 20 bp, Artificial Sequence
  Description of Artificial Sequence: Synthetic oligonucleotide
  Target: SOD1; (-) strand; PAM type: NRG; PAM sequence: AGG
agaggcccaccgccaggacc

SEQ ID NO: 8935 - DNA, 20 bp, Artificial Sequence
  Description of Artificial Sequence: Synthetic oligonucleotide
  Target: SOD1; (-) strand; PAM type: NRG; PAM sequence: CAG
cagaggcccaccgccaggac

SEQ ID NO: 8936 - DNA, 20 bp, Artificial Sequence
  Description of Artificial Sequence: Synthetic oligonucleotide
  Target: SOD1; (-) strand; PAM type: NRG; PAM sequence: AGG
atgcacagaggcccaccgcc

SEQ ID NO: 8937 - DNA, 20 bp, Artificial Sequence
  Description of Artificial Sequence: Synthetic oligonucleotide
  Target: SOD1; (-) strand; PAM type: NRG; PAM sequence: CAG
gatgcacagaggcccaccgc

SEQ ID NO: 8938 - DNA, 20 bp, Artificial Sequence
  Description of Artificial Sequence: Synthetic oligonucleotide
  Target: SOD1; (-) strand; PAM type: NRG; PAM sequence: AGG
ccaccgcacatgatgcacag

SEQ ID NO: 8939 - DNA, 20 bp, Artificial Sequence
  Description of Artificial Sequence: Synthetic oligonucleotide
  Target: SOD1; (-) strand; PAM type: NRG; PAM sequence: GAG
gccaccgcacatgatgcaca

SEQ ID NO: 8940 - DNA, 20 bp, Artificial Sequence
  Description of Artificial Sequence: Synthetic oligonucleotide
  Target: SOD1; (-) strand; PAM type: NRG; PAM sequence: CAG
atgccaccgcacatgatgca

SEQ ID NO: 8941 - DNA, 20 bp, Artificial Sequence
  Description of Artificial Sequence: Synthetic oligonucleotide
  Target: SOD1; (-) strand; PAM type: NRG; PAM sequence: CGG
tgcccccacctcacttacag

SEQ ID NO: 8942 - DNA, 20 bp, Artificial Sequence
  Description of Artificial Sequence: Synthetic oligonucleotide
  Target: SOD1; (-) strand; PAM type: NRG; PAM sequence: CAG
gaatgcccccacctcactta

SEQ ID NO: 8943 - DNA, 20 bp, Artificial Sequence
  Description of Artificial Sequence: Synthetic oligonucleotide
  Target: SOD1; (-) strand; PAM type: NRG; PAM sequence: AGG
atcccactccagcgccctcc

SEQ ID NO: 8944 - DNA, 20 bp, Artificial Sequence
  Description of Artificial Sequence: Synthetic oligonucleotide
  Target: SOD1; (-) strand; PAM type: NRG; PAM sequence: CAG
catcccactccagcgccctc

SEQ ID NO: 8945 - DNA, 20 bp, Artificial Sequence
  Description of Artificial Sequence: Synthetic oligonucleotide
  Target: SOD1; (-) strand; PAM type: NRG; PAM sequence: CAG
ggcccggtctcatcccactc

SEQ ID NO: 8946 - DNA, 20 bp, Artificial Sequence
  Description of Artificial Sequence: Synthetic oligonucleotide
  Target: SOD1; (-) strand; PAM type: NRG; PAM sequence: CGG
ggtcttcttggcgcccggcc

SEQ ID NO: 8947 - DNA, 20 bp, Artificial Sequence
  Description of Artificial Sequence: Synthetic oligonucleotide
  Target: SOD1; (-) strand; PAM type: NRG; PAM sequence: CGG
ctactggtcttcttggcgcc

SEQ ID NO: 8948 - DNA, 20 bp, Artificial Sequence
  Description of Artificial Sequence: Synthetic oligonucleotide
  Target: SOD1; (-) strand; PAM type: NRG; PAM sequence: TGG
gcaccatctactggtcttct

SEQ ID NO: 8949 - DNA, 20 bp, Artificial Sequence
  Description of Artificial Sequence: Synthetic oligonucleotide
  Target: SOD1; (-) strand; PAM type: NRG; PAM sequence: TGG
ggacttcaggcaccatctac

SEQ ID NO: 8950 - DNA, 20 bp, Artificial Sequence
  Description of Artificial Sequence: Synthetic oligonucleotide
  Target: SOD1; (-) strand; PAM type: NRG; PAM sequence: AGG
tggtcctgtaattggacttc

SEQ ID NO: 8951 - DNA, 20 bp, Artificial Sequence
  Description of Artificial Sequence: Synthetic oligonucleotide
  Target: SOD1; (-) strand; PAM type: NRG; PAM sequence: CAG
ctggtcctgtaattggactt

SEQ ID NO: 8952 - DNA, 20 bp, Artificial Sequence
  Description of Artificial Sequence: Synthetic oligonucleotide
  Target: SOD1; (-) strand; PAM type: NRG; PAM sequence: TGG
gttgcccctggtcctgtaat

SEQ ID NO: 8953 - DNA, 20 bp, Artificial Sequence
  Description of Artificial Sequence: Synthetic oligonucleotide
  Target: SOD1; (-) strand; PAM type: NRG; PAM sequence: TGG
ggcactcaaggagttgcccc

SEQ ID NO: 8954 - DNA, 20 bp, Artificial Sequence
  Description of Artificial Sequence: Synthetic oligonucleotide
  Target: SOD1; (-) strand; PAM type: NRG; PAM sequence: GAG
tcgtcttttaggcactcaag

SEQ ID NO: 8955 - DNA, 20 bp, Artificial Sequence
  Description of Artificial Sequence: Synthetic oligonucleotide
  Target: SOD1; (-) strand; PAM type: NRG; PAM sequence: AGG
tgtcgtcttttaggcactca

SEQ ID NO: 8956 - DNA, 20 bp, Artificial Sequence
  Description of Artificial Sequence: Synthetic oligonucleotide
  Target: SOD1; (-) strand; PAM type: NRG; PAM sequence: AAG
ttgtcgtcttttaggcactc

SEQ ID NO: 8957 - DNA, 20 bp, Artificial Sequence
  Description of Artificial Sequence: Synthetic oligonucleotide
  Target: SOD1; (-) strand; PAM type: NRG; PAM sequence: AGG
ttttatttttgtcgtctttt

SEQ ID NO: 8958 - DNA, 20 bp, Artificial Sequence
  Description of Artificial Sequence: Synthetic oligonucleotide
  Target: SOD1; (-) strand; PAM type: NRG; PAM sequence: TAG
tttttatttttgtcgtcttt

SEQ ID NO: 8959 - DNA, 20 bp, Artificial Sequence
  Description of Artificial Sequence: Synthetic oligonucleotide
  Target: SOD1; (-) strand; PAM type: NRG; PAM sequence: TGG
aactggagtgccatcttcgg

SEQ ID NO: 8960 - DNA, 20 bp, Artificial Sequence
  Description of Artificial Sequence: Synthetic oligonucleotide
  Target: SOD1; (-) strand; PAM type: NRG; PAM sequence: CGG
tgaaactggagtgccatctt

SEQ ID NO: 8961 - DNA, 20 bp, Artificial Sequence
  Description of Artificial Sequence: Synthetic oligonucleotide
  Target: SOD1; (-) strand; PAM type: NRG; PAM sequence: GAG
acagaacacagctgaaactg

SEQ ID NO: 8962 - DNA, 20 bp, Artificial Sequence
  Description of Artificial Sequence: Synthetic oligonucleotide
  Target: SOD1; (-) strand; PAM type: NRG; PAM sequence: TGG
ccacagaacacagctgaaac

SEQ ID NO: 8963 - DNA, 20 bp, Artificial Sequence
  Description of Artificial Sequence: Synthetic oligonucleotide
  Target: SOD1; (-) strand; PAM type: NRG; PAM sequence: CAG
gctttaagcgccacagaaca

SEQ ID NO: 8964 - DNA, 20 bp, Artificial Sequence
  Description of Artificial Sequence: Synthetic oligonucleotide
  Target: SOD1; (-) strand; PAM type: NRG; PAM sequence: CAG
ttattttgctttaagcgcca

SEQ ID NO: 8965 - DNA, 20 bp, Artificial Sequence
  Description of Artificial Sequence: Synthetic oligonucleotide
  Target: SOD1; (-) strand; PAM type: NRG; PAM sequence: AAG
gttgaattttattttgcttt

SEQ ID NO: 8966 - DNA, 20 bp, Artificial Sequence
  Description of Artificial Sequence: Synthetic oligonucleotide
  Target: SOD1; (-) strand; PAM type: NRG; PAM sequence: GGG
ctatgaaatttgaagattgt

SEQ ID NO: 8967 - DNA, 20 bp, Artificial Sequence
  Description of Artificial Sequence: Synthetic oligonucleotide
  Target: SOD1; (-) strand; PAM type: NRG; PAM sequence: TGG
actatgaaatttgaagattg

SEQ ID NO: 8968 - DNA, 20 bp, Artificial Sequence
  Description of Artificial Sequence: Synthetic oligonucleotide
  Target: SOD1; (-) strand; PAM type: NRG; PAM sequence: AAG
gtggcaaactatgaaatttg

SEQ ID NO: 8969 - DNA, 20 bp, Artificial Sequence
  Description of Artificial Sequence: Synthetic oligonucleotide
  Target: SOD1; (-) strand; PAM type: NRG; PAM sequence: TGG
acactgggtttgtgacagag

SEQ ID NO: 8970 - DNA, 20 bp, Artificial Sequence
  Description of Artificial Sequence: Synthetic oligonucleotide
  Target: SOD1; (-) strand; PAM type: NRG; PAM sequence: GAG
ctcacactgggtttgtgaca

SEQ ID NO: 8971 - DNA, 20 bp, Artificial Sequence
  Description of Artificial Sequence: Synthetic oligonucleotide
  Target: SOD1; (-) strand; PAM type: NRG; PAM sequence: CAG
gcctcacactgggtttgtga

SEQ ID NO: 8972 - DNA, 20 bp, Artificial Sequence
  Description of Artificial Sequence: Synthetic oligonucleotide
  Target: SOD1; (-) strand; PAM type: NRG; PAM sequence: GGG
ttgttactaggcctcacact

SEQ ID NO: 8973 - DNA, 20 bp, Artificial Sequence
  Description of Artificial Sequence: Synthetic oligonucleotide
  Target: SOD1; (-) strand; PAM type: NRG; PAM sequence: TGG
gttgttactaggcctcacac

SEQ ID NO: 8974 - DNA, 20 bp, Artificial Sequence
  Description of Artificial Sequence: Synthetic oligonucleotide
  Target: SOD1; (-) strand; PAM type: NRG; PAM sequence: AGG
gcttgccttaggttgttact

SEQ ID NO: 8975 - DNA, 20 bp, Artificial Sequence
  Description of Artificial Sequence: Synthetic oligonucleotide
  Target: SOD1; (-) strand; PAM type: NRG; PAM sequence: TAG
tgcttgccttaggttgttac

SEQ ID NO: 8976 - DNA, 20 bp, Artificial Sequence
  Description of Artificial Sequence: Synthetic oligonucleotide
  Target: SOD1; (-) strand; PAM type: NRG; PAM sequence: AGG
tctttgcaattgcttgcctt

SEQ ID NO: 8977 - DNA, 20 bp, Artificial Sequence
  Description of Artificial Sequence: Synthetic oligonucleotide
  Target: SOD1; (-) strand; PAM type: NRG; PAM sequence: TAG
gtctttgcaattgcttgcct

SEQ ID NO: 8978 - DNA, 20 bp, Artificial Sequence
  Description of Artificial Sequence: Synthetic oligonucleotide
  Target: SOD1; (-) strand; PAM type: NRG; PAM sequence: TAG
attctggcctctacctgtat

SEQ ID NO: 8979 - DNA, 20 bp, Artificial Sequence
  Description of Artificial Sequence: Synthetic oligonucleotide
  Target: SOD1; (-) strand; PAM type: NRG; PAM sequence: TGG
ttttatttcccagtttattc

SEQ ID NO: 8980 - DNA, 20 bp, Artificial Sequence
  Description of Artificial Sequence: Synthetic oligonucleotide
  Target: SOD1; (-) strand; PAM type: NRG; PAM sequence: CAG
accattactattttatttcc

SEQ ID NO: 8981 - DNA, 20 bp, Artificial Sequence
  Description of Artificial Sequence: Synthetic oligonucleotide
  Target: SOD1; (-) strand; PAM type: NRG; PAM sequence: TGG
ttgacatactctttgaaaat

SEQ ID NO: 8982 - DNA, 20 bp, Artificial Sequence
  Description of Artificial Sequence: Synthetic oligonucleotide
  Target: SOD1; (-) strand; PAM type: NRG; PAM sequence: GAG
gcttctaatgaaagctacag

SEQ ID NO: 8983 - DNA, 20 bp, Artificial Sequence
  Description of Artificial Sequence: Synthetic oligonucleotide
  Target: SOD1; (-) strand; PAM type: NRG; PAM sequence: AGG
cagcttctaatgaaagctac

SEQ ID NO: 8984 - DNA, 20 bp, Artificial Sequence
  Description of Artificial Sequence: Synthetic oligonucleotide
  Target: SOD1; (-) strand; PAM type: NRG; PAM sequence: CAG
acagcttctaatgaaagcta

SEQ ID NO: 8985 - DNA, 20 bp, Artificial Sequence
  Description of Artificial Sequence: Synthetic oligonucleotide
  Target: SOD1; (-) strand; PAM type: NRG; PAM sequence: AAG
gggaagacagcttctaatga

SEQ ID NO: 8986 - DNA, 20 bp, Artificial Sequence
  Description of Artificial Sequence: Synthetic oligonucleotide
  Target: SOD1; (-) strand; PAM type: NRG; PAM sequence: CAG
atgtatttggagtgggaaga

SEQ ID NO: 8987 - DNA, 20 bp, Artificial Sequence
  Description of Artificial Sequence: Synthetic oligonucleotide
  Target: SOD1; (-) strand; PAM type: NRG; PAM sequence: AAG
tcaaatgtatttggagtggg

SEQ ID NO: 8988 - DNA, 20 bp, Artificial Sequence
  Description of Artificial Sequence: Synthetic oligonucleotide
  Target: SOD1; (-) strand; PAM type: NRG; PAM sequence: GGG
ttctcaaatgtatttggagt

SEQ ID NO: 8989 - DNA, 20 bp, Artificial Sequence
  Description of Artificial Sequence: Synthetic oligonucleotide
  Target: SOD1; (-) strand; PAM type: NRG; PAM sequence: TGG
tttctcaaatgtatttggag

SEQ ID NO: 8990 - DNA, 20 bp, Artificial Sequence
  Description of Artificial Sequence: Synthetic oligonucleotide
  Target: SOD1; (-) strand; PAM type: NRG; PAM sequence: GAG
gtgtttctcaaatgtatttg

SEQ ID NO: 8991 - DNA, 20 bp, Artificial Sequence
  Description of Artificial Sequence: Synthetic oligonucleotide
  Target: SOD1; (-) strand; PAM type: NRG; PAM sequence: TGG
ctgtgtttctcaaatgtatt

SEQ ID NO: 8992 - DNA, 20 bp, Artificial Sequence
  Description of Artificial Sequence: Synthetic oligonucleotide
  Target: SOD1; (-) strand; PAM type: NRG; PAM sequence: TAG
gtatttatctcattaggact

SEQ ID NO: 8993 - DNA, 20 bp, Artificial Sequence
  Description of Artificial Sequence: Synthetic oligonucleotide
  Target: SOD1; (-) strand; PAM type: NRG; PAM sequence: AGG
gtgaatgtatttatctcatt

SEQ ID NO: 8994 - DNA, 20 bp, Artificial Sequence
  Description of Artificial Sequence: Synthetic oligonucleotide
  Target: SOD1; (-) strand; PAM type: NRG; PAM sequence: TAG
agtgaatgtatttatctcat

SEQ ID NO: 8995 - DNA, 20 bp, Artificial Sequence
  Description of Artificial Sequence: Synthetic oligonucleotide
  Target: SOD1; (-) strand; PAM type: NRG; PAM sequence: TAG
ttagcttgaatagttactga

SEQ ID NO: 8996 - DNA, 20 bp, Artificial Sequence
  Description of Artificial Sequence: Synthetic oligonucleotide
  Target: SOD1; (-) strand; PAM type: NRG; PAM sequence: TAG
gtatgcttagttagcttgaa

SEQ ID NO: 8997 - DNA, 20 bp, Artificial Sequence
  Description of Artificial Sequence: Synthetic oligonucleotide
  Target: SOD1; (-) strand; PAM type: NRG; PAM sequence: TAG
gcacctgcagtatgcttagt

SEQ ID NO: 8998 - DNA, 20 bp, Artificial Sequence
  Description of Artificial Sequence: Synthetic oligonucleotide
  Target: SOD1; (-) strand; PAM type: NRG; PAM sequence: TAG
gtgtgcacctgcagtatgct

SEQ ID NO: 8999 - DNA, 20 bp, Artificial Sequence
  Description of Artificial Sequence: Synthetic oligonucleotide
  Target: SOD1; (-) strand; PAM type: NRG; PAM sequence: CAG
attttctaagtgtgcacctg

SEQ ID NO: 9000 - DNA, 20 bp, Artificial Sequence
  Description of Artificial Sequence: Synthetic oligonucleotide
  Target: SOD1; (-) strand; PAM type: NRG; PAM sequence: AAG
agacggggtgtaaattttct

SEQ ID NO: 9001 - DNA, 20 bp, Artificial Sequence
  Description of Artificial Sequence: Synthetic oligonucleotide
  Target: SOD1; (-) strand; PAM type: NRG; PAM sequence: GGG
ttttttctagtaataagacg

SEQ ID NO: 9002 - DNA, 20 bp, Artificial Sequence
  Description of Artificial Sequence: Synthetic oligonucleotide
  Target: SOD1; (-) strand; PAM type: NRG; PAM sequence: GGG
tttttttctagtaataagac

SEQ ID NO: 9003 - DNA, 20 bp, Artificial Sequence
  Description of Artificial Sequence: Synthetic oligonucleotide
  Target: SOD1; (-) strand; PAM type: NRG; PAM sequence: CGG
atttttttctagtaataaga

SEQ ID NO: 9004 - DNA, 20 bp, Artificial Sequence
  Description of Artificial Sequence: Synthetic oligonucleotide
  Target: SOD1; (-) strand; PAM type: NRG; PAM sequence: AAG
cctcatttttttctagtaat

SEQ ID NO: 9005 - DNA, 20 bp, Artificial Sequence
  Description of Artificial Sequence: Synthetic oligonucleotide
  Target: SOD1; (-) strand; PAM type: NRG; PAM sequence: TAG
tcagtgacctcatttttttc

SEQ ID NO: 9006 - DNA, 20 bp, Artificial Sequence
  Description of Artificial Sequence: Synthetic oligonucleotide
  Target: SOD1; (-) strand; PAM type: NRG; PAM sequence: CAG
ctttcctgggttttctaggt

SEQ ID NO: 9007 - DNA, 20 bp, Artificial Sequence
  Description of Artificial Sequence: Synthetic oligonucleotide
  Target: SOD1; (-) strand; PAM type: NRG; PAM sequence: AGG
tcctctttcctgggttttct

SEQ ID NO: 9008 - DNA, 20 bp, Artificial Sequence
  Description of Artificial Sequence: Synthetic oligonucleotide
  Target: SOD1; (-) strand; PAM type: NRG; PAM sequence: TAG
ttcctctttcctgggttttc

SEQ ID NO: 9009 - DNA, 20 bp, Artificial Sequence
  Description of Artificial Sequence: Synthetic oligonucleotide
  Target: SOD1; (-) strand; PAM type: NRG; PAM sequence: GGG
aagagatcttcctctttcct

SEQ ID NO: 9010 - DNA, 20 bp, Artificial Sequence
  Description of Artificial Sequence: Synthetic oligonucleotide
  Target: SOD1; (-) strand; PAM type: NRG; PAM sequence: TGG
aaagagatcttcctctttcc

SEQ ID NO: 9011 - DNA, 20 bp, Artificial Sequence
  Description of Artificial Sequence: Synthetic oligonucleotide
  Target: SOD1; (-) strand; PAM type: NRG; PAM sequence: GAG
aagtgtagcatggagtcaaa

SEQ ID NO: 9012 - DNA, 20 bp, Artificial Sequence
  Description of Artificial Sequence: Synthetic oligonucleotide
  Target: SOD1; (-) strand; PAM type: NRG; PAM sequence: AAG
ctaagtgtagcatggagtca

SEQ ID NO: 9013 - DNA, 20 bp, Artificial Sequence
  Description of Artificial Sequence: Synthetic oligonucleotide
  Target: SOD1; (-) strand; PAM type: NRG; PAM sequence: GAG
tatggactaagtgtagcatg

SEQ ID NO: 9014 - DNA, 20 bp, Artificial Sequence
  Description of Artificial Sequence: Synthetic oligonucleotide
  Target: SOD1; (-) strand; PAM type: NRG; PAM sequence: TGG
aatatggactaagtgtagca

SEQ ID NO: 9015 - DNA, 20 bp, Artificial Sequence
  Description of Artificial Sequence: Synthetic oligonucleotide
  Target: SOD1; (-) strand; PAM type: NRG; PAM sequence: TAG
ttaataatatggactaagtg

SEQ ID NO: 9016 - DNA, 20 bp, Artificial Sequence
  Description of Artificial Sequence: Synthetic oligonucleotide
  Target: SOD1; (-) strand; PAM type: NRG; PAM sequence: AAG
gcattttaataatatggact

SEQ ID NO: 9017 - DNA, 20 bp, Artificial Sequence
  Description of Artificial Sequence: Synthetic oligonucleotide
  Target: SOD1; (-) strand; PAM type: NRG; PAM sequence: TGG
catgaggcattttaataata

SEQ ID NO: 9018 - DNA, 20 bp, Artificial Sequence
  Description of Artificial Sequence: Synthetic oligonucleotide
  Target: SOD1; (-) strand; PAM type: NRG; PAM sequence: AGG
cattgcatagtaactgcatg

SEQ ID NO: 9019 - DNA, 20 bp, Artificial Sequence
  Description of Artificial Sequence: Synthetic oligonucleotide
  Target: SOD1; (-) strand; PAM type: NRG; PAM sequence: GAG
acattgcatagtaactgcat

SEQ ID NO: 9020 - DNA, 20 bp, Artificial Sequence
  Description of Artificial Sequence: Synthetic oligonucleotide
  Target: SOD1; (-) strand; PAM type: NRG; PAM sequence: TAG
tttatttgatgcacattgca

SEQ ID NO: 9021 - DNA, 20 bp, Artificial Sequence
  Description of Artificial Sequence: Synthetic oligonucleotide
  Target: SOD1; (-) strand; PAM type: NRG; PAM sequence: TAG
gatctttgttttgtagacat

SEQ ID NO: 9022 - DNA, 20 bp, Artificial Sequence
  Description of Artificial Sequence: Synthetic oligonucleotide
  Target: SOD1; (-) strand; PAM type: NRG; PAM sequence: TAG
gtgtatggatctttgttttg

SEQ ID NO: 9023 - DNA, 20 bp, Artificial Sequence
  Description of Artificial Sequence: Synthetic oligonucleotide
  Target: SOD1; (-) strand; PAM type: NRG; PAM sequence: TGG
gtaaacttcacatttgtgta

SEQ ID NO: 9024 - DNA, 20 bp, Artificial Sequence
  Description of Artificial Sequence: Synthetic oligonucleotide
  Target: SOD1; (-) strand; PAM type: NRG; PAM sequence: CAG
ccttgaaaaaggaactgtaa

SEQ ID NO: 9025 - DNA, 20 bp, Artificial Sequence
  Description of Artificial Sequence: Synthetic oligonucleotide
  Target: SOD1; (-) strand; PAM type: NRG; PAM sequence: AGG
atcatgctgtgccttgaaaa

SEQ ID NO: 9026 - DNA, 20 bp, Artificial Sequence
  Description of Artificial Sequence: Synthetic oligonucleotide
  Target: SOD1; (-) strand; PAM type: NRG; PAM sequence: AAG
tatcatgctgtgccttgaaa

SEQ ID NO: 9027 - DNA, 20 bp, Artificial Sequence
  Description of Artificial Sequence: Synthetic oligonucleotide
  Target: SOD1; (-) strand; PAM type: NRG; PAM sequence: AAG
tcaggtcgtgatggcctcgc

SEQ ID NO: 9028 - DNA, 20 bp, Artificial Sequence
  Description of Artificial Sequence: Synthetic oligonucleotide
  Target: SOD1; (-) strand; PAM type: NRG; PAM sequence: TGG
gagcattattcaggtcgtga

SEQ ID NO: 9029 - DNA, 20 bp, Artificial Sequence
  Description of Artificial Sequence: Synthetic oligonucleotide
  Target: SOD1; (-) strand; PAM type: NRG; PAM sequence: AGG
ctgaacattgagcattattc

SEQ ID NO: 9030 - DNA, 20 bp, Artificial Sequence
  Description of Artificial Sequence: Synthetic oligonucleotide
  Target: SOD1; (-) strand; PAM type: NRG; PAM sequence: CAG
gctgaacattgagcattatt

SEQ ID NO: 9031 - DNA, 20 bp, Artificial Sequence
  Description of Artificial Sequence: Synthetic oligonucleotide
  Target: SOD1; (-) strand; PAM type: NRG; PAM sequence: GAG
aaggtgaacagctgaacatt

SEQ ID NO: 9032 - DNA, 20 bp, Artificial Sequence
  Description of Artificial Sequence: Synthetic oligonucleotide
  Target: SOD1; (-) strand; PAM type: NRG; PAM sequence: CAG
aataatgaatagaaggtgaa

SEQ ID NO: 9033 - DNA, 20 bp, Artificial Sequence
  Description of Artificial Sequence: Synthetic oligonucleotide
  Target: SOD1; (-) strand; PAM type: NRG; PAM sequence: AGG
gaatagaaataatgaataga

SEQ ID NO: 9034 - DNA, 20 bp, Artificial Sequence
  Description of Artificial Sequence: Synthetic oligonucleotide
  Target: SOD1; (-) strand; PAM type: NRG; PAM sequence: AAG
tgaatagaaataatgaatag

SEQ ID NO: 9035 - DNA, 20 bp, Artificial Sequence
  Description of Artificial Sequence: Synthetic oligonucleotide
  Target: SOD1; (-) strand; PAM type: NRG; PAM sequence: TAG
gaatgaatagaaataatgaa

SEQ ID NO: 9036 - DNA, 20 bp, Artificial Sequence
  Description of Artificial Sequence: Synthetic oligonucleotide
  Target: SOD1; (-) strand; PAM type: NRG; PAM sequence: TAG
gccacctttggaagaatgaa

SEQ ID NO: 9037 - DNA, 20 bp, Artificial Sequence
  Description of Artificial Sequence: Synthetic oligonucleotide
  Target: SOD1; (-) strand; PAM type: NRG; PAM sequence: AAG
accagacttgccacctttgg

SEQ ID NO: 9038 - DNA, 20 bp, Artificial Sequence
  Description of Artificial Sequence: Synthetic oligonucleotide
  Target: SOD1; (-) strand; PAM type: NRG; PAM sequence: TGG
cttaccagacttgccacctt

SEQ ID NO: 9039 - DNA, 20 bp, Artificial Sequence
  Description of Artificial Sequence: Synthetic oligonucleotide
  Target: SOD1; (-) strand; PAM type: NRG; PAM sequence: CAG
ttcagcagcaccaaccttac

SEQ ID NO: 9040 - DNA, 20 bp, Artificial Sequence
  Description of Artificial Sequence: Synthetic oligonucleotide
  Target: SOD1; (-) strand; PAM type: NRG; PAM sequence: CAG
agaagtcattgttatttcag

SEQ ID NO: 9041 - DNA, 20 bp, Artificial Sequence
  Description of Artificial Sequence: Synthetic oligonucleotide
  Target: SOD1; (-) strand; PAM type: NRG; PAM sequence: CAG
ccaagaagtcattgttattt

SEQ ID NO: 9042 - DNA, 20 bp, Artificial Sequence
  Description of Artificial Sequence: Synthetic oligonucleotide
  Target: SOD1; (-) strand; PAM type: NRG; PAM sequence: AAG
gataggaaaataaaaccaag

SEQ ID NO: 9043 - DNA, 20 bp, Artificial Sequence
  Description of Artificial Sequence: Synthetic oligonucleotide
  Target: SOD1; (-) strand; PAM type: NRG; PAM sequence: AAG
gtagataggaaaataaaacc

SEQ ID NO: 9044 - DNA, 20 bp, Artificial Sequence
  Description of Artificial Sequence: Synthetic oligonucleotide
  Target: SOD1; (-) strand; PAM type: NRG; PAM sequence: AGG
gagcaaaccctcatgtagat

SEQ ID NO: 9045 - DNA, 20 bp, Artificial Sequence
  Description of Artificial Sequence: Synthetic oligonucleotide
  Target: SOD1; (-) strand; PAM type: NRG; PAM sequence: TAG
tgagcaaaccctcatgtaga

SEQ ID NO: 9046 - DNA, 20 bp, Artificial Sequence
  Description of Artificial Sequence: Synthetic oligonucleotide
  Target: SOD1; (-) strand; PAM type: NRG; PAM sequence: TAG
agtatgagcaaaccctcatg

SEQ ID NO: 9047 - DNA, 20 bp, Artificial Sequence
  Description of Artificial Sequence: Synthetic oligonucleotide
  Target: SOD1; (-) strand; PAM type: NRG; PAM sequence: GAG
cgtgactcttatatcagtat

SEQ ID NO: 9048 - DNA, 20 bp, Artificial Sequence
  Description of Artificial Sequence: Synthetic oligonucleotide
  Target: SOD1; (-) strand; PAM type: NRG; PAM sequence: CAG
aacttgcgtgactcttatat

SEQ ID NO: 9049 - DNA, 20 bp, Artificial Sequence
  Description of Artificial Sequence: Synthetic oligonucleotide
  Target: SOD1; (-) strand; PAM type: NRG; PAM sequence: AGG
aaccccaagcagaaaatgac

SEQ ID NO: 9050 - DNA, 20 bp, Artificial Sequence
  Description of Artificial Sequence: Synthetic oligonucleotide
  Target: SOD1; (-) strand; PAM type: NRG; PAM sequence: CAG
gaaccccaagcagaaaatga

SEQ ID NO: 9051 - DNA, 20 bp, Artificial Sequence
  Description of Artificial Sequence: Synthetic oligonucleotide
  Target: SOD1; (-) strand; PAM type: NRG; PAM sequence: CAG
cctaagtggtgaaccccaag

SEQ ID NO: 9052 - DNA, 20 bp, Artificial Sequence
  Description of Artificial Sequence: Synthetic oligonucleotide
  Target: SOD1; (-) strand; PAM type: NRG; PAM sequence: AAG
gtacctaagtggtgaacccc

SEQ ID NO: 9053 - DNA, 20 bp, Artificial Sequence
  Description of Artificial Sequence: Synthetic oligonucleotide
  Target: SOD1; (-) strand; PAM type: NRG; PAM sequence: TGG
aatgcttttctgtacctaag

SEQ ID NO: 9054 - DNA, 20 bp, Artificial Sequence
  Description of Artificial Sequence: Synthetic oligonucleotide
  Target: SOD1; (-) strand; PAM type: NRG; PAM sequence: AAG
tccaatgcttttctgtacct

SEQ ID NO: 9055 - DNA, 20 bp, Artificial Sequence
  Description of Artificial Sequence: Synthetic oligonucleotide
  Target: SOD1; (-) strand; PAM type: NRG; PAM sequence: GAG
tttgcaaaaggataaattga

SEQ ID NO: 9056 - DNA, 20 bp, Artificial Sequence
  Description of Artificial Sequence: Synthetic oligonucleotide
  Target: SOD1; (-) strand; PAM type: NRG; PAM sequence: GAG
tatttgcaaaaggataaatt

SEQ ID NO: 9057 - DNA, 20 bp, Artificial Sequence
  Description of Artificial Sequence: Synthetic oligonucleotide
  Target: SOD1; (-) strand; PAM type: NRG; PAM sequence: AGG
gtcttatttatatttgcaaa

SEQ ID NO: 9058 - DNA, 20 bp, Artificial Sequence
  Description of Artificial Sequence: Synthetic oligonucleotide
  Target: SOD1; (-) strand; PAM type: NRG; PAM sequence: AAG
tgtcttatttatatttgcaa

SEQ ID NO: 9059 - DNA, 20 bp, Artificial Sequence
  Description of Artificial Sequence: Synthetic oligonucleotide
  Target: SOD1; (-) strand; PAM type: NRG; PAM sequence: TAG
tcctttcaatcatagtatta

SEQ ID NO: 9060 - DNA, 20 bp, Artificial Sequence
  Description of Artificial Sequence: Synthetic oligonucleotide
  Target: SOD1; (-) strand; PAM type: NRG; PAM sequence: TAG
agaataactcctttcaatca

SEQ ID NO: 9061 - DNA, 20 bp, Artificial Sequence
  Description of Artificial Sequence: Synthetic oligonucleotide
  Target: SOD1; (-) strand; PAM type: NRG; PAM sequence: CAG
cctggaacattttccattat

SEQ ID NO: 9062 - DNA, 20 bp, Artificial Sequence
  Description of Artificial Sequence: Synthetic oligonucleotide
  Target: SOD1; (-) strand; PAM type: NRG; PAM sequence: TGG
agcatgttcttaacagtacc

SEQ ID NO: 9063 - DNA, 20 bp, Artificial Sequence
  Description of Artificial Sequence: Synthetic oligonucleotide
  Target: SOD1; (-) strand; PAM type: NRG; PAM sequence: CAG
ggtaaatagcatgttcttaa

SEQ ID NO: 9064 - DNA, 20 bp, Artificial Sequence
  Description of Artificial Sequence: Synthetic oligonucleotide
  Target: SOD1; (-) strand; PAM type: NRG; PAM sequence: TAG
ttctgcagcacatgggtaaa

SEQ ID NO: 9065 - DNA, 20 bp, Artificial Sequence
  Description of Artificial Sequence: Synthetic oligonucleotide
  Target: SOD1; (-) strand; PAM type: NRG; PAM sequence: GGG
aagacctttctgcagcacat

SEQ ID NO: 9066 - DNA, 20 bp, Artificial Sequence
  Description of Artificial Sequence: Synthetic oligonucleotide
  Target: SOD1; (-) strand; PAM type: NRG; PAM sequence: TGG
aaagacctttctgcagcaca

SEQ ID NO: 9067 - DNA, 20 bp, Artificial Sequence
  Description of Artificial Sequence: Synthetic oligonucleotide
  Target: SOD1; (-) strand; PAM type: NRG; PAM sequence: CAG
cttgctcaaagacctttctg

SEQ ID NO: 9068 - DNA, 20 bp, Artificial Sequence
  Description of Artificial Sequence: Synthetic oligonucleotide
  Target: SOD1; (-) strand; PAM type: NRG; PAM sequence: AAG
cataacccataacttgctca

SEQ ID NO: 9069 - DNA, 20 bp, Artificial Sequence
  Description of Artificial Sequence: Synthetic oligonucleotide
  Target: SOD1; (-) strand; PAM type: NRG; PAM sequence: AAG
tttttctgtcagtgtcaccc

SEQ ID NO: 9070 - DNA, 20 bp, Artificial Sequence
  Description of Artificial Sequence: Synthetic oligonucleotide
  Target: SOD1; (-) strand; PAM type: NRG; PAM sequence: CAG
ccaattggtcatttttctgt

SEQ ID NO: 9071 - DNA, 20 bp, Artificial Sequence
  Description of Artificial Sequence: Synthetic oligonucleotide
  Target: SOD1; (-) strand; PAM type: NRG; PAM sequence: TGG
ggtaatcagcatttcccaat

SEQ ID NO: 9072 - DNA, 20 bp, Artificial Sequence
  Description of Artificial Sequence: Synthetic oligonucleotide
  Target: SOD1; (-) strand; PAM type: NRG; PAM sequence: CAG
ggcgcttttgctgtggtaat

SEQ ID NO: 9073 - DNA, 20 bp, Artificial Sequence
  Description of Artificial Sequence: Synthetic oligonucleotide
  Target: SOD1; (-) strand; PAM type: NRG; PAM sequence: TGG
aatttctggcgcttttgctg

SEQ ID NO: 9074 - DNA, 20 bp, Artificial Sequence
  Description of Artificial Sequence: Synthetic oligonucleotide
  Target: SOD1; (-) strand; PAM type: NRG; PAM sequence: TGG
ctcatccatttcacaatttc

SEQ ID NO: 9075 - DNA, 20 bp, Artificial Sequence
  Description of Artificial Sequence: Synthetic oligonucleotide
  Target: SOD1; (-) strand; PAM type: NRG; PAM sequence: GAG
gaagagcctgtgaagggaca

SEQ ID NO: 9076 - DNA, 20 bp, Artificial Sequence
  Description of Artificial Sequence: Synthetic oligonucleotide
  Target: SOD1; (-) strand; PAM type: NRG; PAM sequence: CAG
ctgaagagcctgtgaaggga

SEQ ID NO: 9077 - DNA, 20 bp, Artificial Sequence
  Description of Artificial Sequence: Synthetic oligonucleotide
  Target: SOD1; (-) strand; PAM type: NRG; PAM sequence: GGG
gtgtctgaagagcctgtgaa

SEQ ID NO: 9078 - DNA, 20 bp, Artificial Sequence
  Description of Artificial Sequence: Synthetic oligonucleotide
  Target: SOD1; (-) strand; PAM type: NRG; PAM sequence: AGG
agtgtctgaagagcctgtga

SEQ ID NO: 9079 - DNA, 20 bp, Artificial Sequence
  Description of Artificial Sequence: Synthetic oligonucleotide
  Target: SOD1; (-) strand; PAM type: NRG; PAM sequence: AAG
aagtgtctgaagagcctgtg

SEQ ID NO: 9080 - DNA, 20 bp, Artificial Sequence
  Description of Artificial Sequence: Synthetic oligonucleotide
  Target: SOD1; (-) strand; PAM type: NRG; PAM sequence: GAG
attttcccaaagtgtctgaa

SEQ ID NO: 9081 - DNA, 20 bp, Artificial Sequence
  Description of Artificial Sequence: Synthetic oligonucleotide
  Target: SOD1; (-) strand; PAM type: NRG; PAM sequence: AAG
ggattttcccaaagtgtctg

SEQ ID NO: 9082 - DNA, 20 bp, Artificial Sequence
  Description of Artificial Sequence: Synthetic oligonucleotide
  Target: SOD1; (-) strand; PAM type: NRG; PAM sequence: AAG
tgttcattgggattttccca

SEQ ID NO: 9083 - DNA, 20 bp, Artificial Sequence
  Description of Artificial Sequence: Synthetic oligonucleotide
  Target: SOD1; (-) strand; PAM type: NRG; PAM sequence: GGG
gtgtcctgtacttgttcatt

SEQ ID NO: 9084 - DNA, 20 bp, Artificial Sequence
  Description of Artificial Sequence: Synthetic oligonucleotide
  Target: SOD1; (-) strand; PAM type: NRG; PAM sequence: TGG
ggtgtcctgtacttgttcat

SEQ ID NO: 9085 - DNA, 20 bp, Artificial Sequence
  Description of Artificial Sequence: Synthetic oligonucleotide
  Target: SOD1; (-) strand; PAM type: NRG; PAM sequence: TGG
tatctgagatacagtgtagc

SEQ ID NO: 9086 - DNA, 20 bp, Artificial Sequence
  Description of Artificial Sequence: Synthetic oligonucleotide
  Target: SOD1; (-) strand; PAM type: NRG; PAM sequence: TAG
tttctatctgagatacagtg

SEQ ID NO: 9087 - DNA, 20 bp, Artificial Sequence
  Description of Artificial Sequence: Synthetic oligonucleotide
  Target: SOD1; (-) strand; PAM type: NRG; PAM sequence: CAG
ttttatttctatctgagata

SEQ ID NO: 9088 - DNA, 20 bp, Artificial Sequence
  Description of Artificial Sequence: Synthetic oligonucleotide
  Target: SOD1; (-) strand; PAM type: NRG; PAM sequence: GAG
agagtgttttatttctatct

SEQ ID NO: 9089 - DNA, 20 bp, Artificial Sequence
  Description of Artificial Sequence: Synthetic oligonucleotide
  Target: SOD1; (-) strand; PAM type: NRG; PAM sequence: GAG
tatttcccaaatgatgtgaa

SEQ ID NO: 9090 - DNA, 20 bp, Artificial Sequence
  Description of Artificial Sequence: Synthetic oligonucleotide
  Target: SOD1; (-) strand; PAM type: NRG; PAM sequence: AAG
aatatttcccaaatgatgtg

SEQ ID NO: 9091 - DNA, 20 bp, Artificial Sequence
  Description of Artificial Sequence: Synthetic oligonucleotide
  Target: SOD1; (-) strand; PAM type: NRG; PAM sequence: CGG
cccagtgtatggtatatact

SEQ ID NO: 9092 - DNA, 20 bp, Artificial Sequence
  Description of Artificial Sequence: Synthetic oligonucleotide
  Target: SOD1; (-) strand; PAM type: NRG; PAM sequence: TGG
gcttctgttgccccagtgta

SEQ ID NO: 9093 - DNA, 20 bp, Artificial Sequence
  Description of Artificial Sequence: Synthetic oligonucleotide
  Target: SOD1; (-) strand; PAM type: NRG; PAM sequence: CAG
gacatgtgcttctgttgccc

SEQ ID NO: 9094 - DNA, 20 bp, Artificial Sequence
  Description of Artificial Sequence: Synthetic oligonucleotide
  Target: SOD1; (-) strand; PAM type: NRG; PAM sequence: AGG
ttctttacaaagtgaaagca

SEQ ID NO: 9095 - DNA, 20 bp, Artificial Sequence
  Description of Artificial Sequence: Synthetic oligonucleotide
  Target: SOD1; (-) strand; PAM type: NRG; PAM sequence: AAG
tttctttacaaagtgaaagc

SEQ ID NO: 9096 - DNA, 20 bp, Artificial Sequence
  Description of Artificial Sequence: Synthetic oligonucleotide
  Target: SOD1; (-) strand; PAM type: NRG; PAM sequence: AAG
actatttctttacaaagtga

SEQ ID NO: 9097 - DNA, 20 bp, Artificial Sequence
  Description of Artificial Sequence: Synthetic oligonucleotide
  Target: SOD1; (-) strand; PAM type: NRG; PAM sequence: AAG
aactacactatttctttaca

SEQ ID NO: 9098 - DNA, 20 bp, Artificial Sequence
  Description of Artificial Sequence: Synthetic oligonucleotide
  Target: SOD1; (-) strand; PAM type: NRG; PAM sequence: TGG
ggattaaagtccacaggtgt

SEQ ID NO: 9099 - DNA, 20 bp, Artificial Sequence
  Description of Artificial Sequence: Synthetic oligonucleotide
  Target: SOD1; (-) strand; PAM type: NRG; PAM sequence: AGG
tgttttggattaaagtccac

SEQ ID NO: 9100 - DNA, 20 bp, Artificial Sequence
  Description of Artificial Sequence: Synthetic oligonucleotide
  Target: SOD1; (-) strand; PAM type: NRG; PAM sequence: CAG
atgttttggattaaagtcca

SEQ ID NO: 9101 - DNA, 20 bp, Artificial Sequence
  Description of Artificial Sequence: Synthetic oligonucleotide
  Target: SOD1; (-) strand; PAM type: NRG; PAM sequence: AAG
acattttatgttttggatta

SEQ ID NO: 9102 - DNA, 20 bp, Artificial Sequence
  Description of Artificial Sequence: Synthetic oligonucleotide
  Target: SOD1; (-) strand; PAM type: NRG; PAM sequence: TGG
ggcatatacattttatgttt

SEQ ID NO: 9103 - DNA, 20 bp, Artificial Sequence
  Description of Artificial Sequence: Synthetic oligonucleotide
  Target: SOD1; (-) strand; PAM type: NRG; PAM sequence: GGG
tattaaaagagactgtgcct

SEQ ID NO: 9104 - DNA, 20 bp, Artificial Sequence
  Description of Artificial Sequence: Synthetic oligonucleotide
  Target: SOD1; (-) strand; PAM type: NRG; PAM sequence: TGG
ctattaaaagagactgtgcc

SEQ ID NO: 9105 - DNA, 20 bp, Artificial Sequence
  Description of Artificial Sequence: Synthetic oligonucleotide
  Target: SOD1; (-) strand; PAM type: NRG; PAM sequence: GAG
taatgatccctctattaaaa

SEQ ID NO: 9106 - DNA, 20 bp, Artificial Sequence
  Description of Artificial Sequence: Synthetic oligonucleotide
  Target: SOD1; (-) strand; PAM type: NRG; PAM sequence: AAG
tataatgatccctctattaa

SEQ ID NO: 9107 - DNA, 20 bp, Artificial Sequence
  Description of Artificial Sequence: Synthetic oligonucleotide
  Target: SOD1; (-) strand; PAM type: NRG; PAM sequence: AGG
agtaaagttcagtttgtttc

SEQ ID NO: 9108 - DNA, 20 bp, Artificial Sequence
  Description of Artificial Sequence: Synthetic oligonucleotide
  Target: SOD1; (-) strand; PAM type: NRG; PAM sequence: CAG
aagtaaagttcagtttgttt

SEQ ID NO: 9109 - DNA, 20 bp, Artificial Sequence
  Description of Artificial Sequence: Synthetic oligonucleotide
  Target: SOD1; (-) strand; PAM type: NRG; PAM sequence: CAG
ggtaatgggaaagtaaagtt

SEQ ID NO: 9110 - DNA, 20 bp, Artificial Sequence
  Description of Artificial Sequence: Synthetic oligonucleotide
  Target: SOD1; (-) strand; PAM type: NRG; PAM sequence: AAG
taaaaggtaatgggaaagta

SEQ ID NO: 9111 - DNA, 20 bp, Artificial Sequence
  Description of Artificial Sequence: Synthetic oligonucleotide
  Target: SOD1; (-) strand; PAM type: NRG; PAM sequence: AAG
actgataaaaggtaatggga

SEQ ID NO: 9112 - DNA, 20 bp, Artificial Sequence
  Description of Artificial Sequence: Synthetic oligonucleotide
  Target: SOD1; (-) strand; PAM type: NRG; PAM sequence: GGG
ctttactgataaaaggtaat

SEQ ID NO: 9113 - DNA, 20 bp, Artificial Sequence
  Description of Artificial Sequence: Synthetic oligonucleotide
  Target: SOD1; (-) strand; PAM type: NRG; PAM sequence: TGG
tctttactgataaaaggtaa

SEQ ID NO: 9114 - DNA, 20 bp, Artificial Sequence
  Description of Artificial Sequence: Synthetic oligonucleotide
  Target: SOD1; (-) strand; PAM type: NRG; PAM sequence: AGG
aacaaatctttactgataaa

SEQ ID NO: 9115 - DNA, 20 bp, Artificial Sequence
  Description of Artificial Sequence: Synthetic oligonucleotide
  Target: SOD1; (-) strand; PAM type: NRG; PAM sequence: AAG
aaacaaatctttactgataa

SEQ ID NO: 9116 - DNA, 20 bp, Artificial Sequence
  Description of Artificial Sequence: Synthetic oligonucleotide
  Target: SOD1; (-) strand; PAM type: NRG; PAM sequence: TGG
aacattggtcattttagtcc

SEQ ID NO: 9117 - DNA, 20 bp, Artificial Sequence
  Description of Artificial Sequence: Synthetic oligonucleotide
  Target: SOD1; (-) strand; PAM type: NRG; PAM sequence: TAG
acagtaaacattggtcattt

SEQ ID NO: 9118 - DNA, 20 bp, Artificial Sequence
  Description of Artificial Sequence: Synthetic oligonucleotide
  Target: SOD1; (-) strand; PAM type: NRG; PAM sequence: TGG
cctccgttaacagtaaacat

SEQ ID NO: 9119 - DNA, 20 bp, Artificial Sequence
  Description of Artificial Sequence: Synthetic oligonucleotide
  Target: SOD1; (-) strand; PAM type: NRG; PAM sequence: CAG
tctatgctgacctccgttaa

SEQ ID NO: 9120 - DNA, 20 bp, Artificial Sequence
  Description of Artificial Sequence: Synthetic oligonucleotide
  Target: SOD1; (+) strand; PAM type: NRG; PAM sequence: GGG
tccactgggtgacgccagct

SEQ ID NO: 9121 - DNA, 20 bp, Artificial Sequence
  Description of Artificial Sequence: Synthetic oligonucleotide
  Target: SOD1; (+) strand; PAM type: NRG; PAM sequence: GAG
gtgacgccagctgggctcct

SEQ ID NO: 9122 - DNA, 20 bp, Artificial Sequence
  Description of Artificial Sequence: Synthetic oligonucleotide
  Target: SOD1; (+) strand; PAM type: NRG; PAM sequence: TAG
gccagctgggctcctgagtt

SEQ ID NO: 9123 - DNA, 20 bp, Artificial Sequence
  Description of Artificial Sequence: Synthetic oligonucleotide
  Target: SOD1; (+) strand; PAM type: NRG; PAM sequence: TGG
agctgggctcctgagtttag

SEQ ID NO: 9124 - DNA, 20 bp, Artificial Sequence
  Description of Artificial Sequence: Synthetic oligonucleotide
  Target: SOD1; (+) strand; PAM type: NRG; PAM sequence: GGG
gctgggctcctgagtttagt

SEQ ID NO: 9125 - DNA, 20 bp, Artificial Sequence
  Description of Artificial Sequence: Synthetic oligonucleotide
  Target: SOD1; (+) strand; PAM type: NRG; PAM sequence: GGG
ctgggctcctgagtttagtg

SEQ ID NO: 9126 - DNA, 20 bp, Artificial Sequence
  Description of Artificial Sequence: Synthetic oligonucleotide
  Target: SOD1; (+) strand; PAM type: NRG; PAM sequence: CAG
ctgagtttagtggggacctg

SEQ ID NO: 9127 - DNA, 20 bp, Artificial Sequence
  Description of Artificial Sequence: Synthetic oligonucleotide
  Target: SOD1; (+) strand; PAM type: NRG; PAM sequence: TAG
acctgcagaacctttatgtc

SEQ ID NO: 9128 - DNA, 20 bp, Artificial Sequence
  Description of Artificial Sequence: Synthetic oligonucleotide
  Target: SOD1; (+) strand; PAM type: NRG; PAM sequence: AAG
cagaacctttatgtctagct

SEQ ID NO: 9129 - DNA, 20 bp, Artificial Sequence
  Description of Artificial Sequence: Synthetic oligonucleotide
  Target: SOD1; (+) strand; PAM type: NRG; PAM sequence: AGG
agaacctttatgtctagcta

SEQ ID NO: 9130 - DNA, 20 bp, Artificial Sequence
  Description of Artificial Sequence: Synthetic oligonucleotide
  Target: SOD1; (+) strand; PAM type: NRG; PAM sequence: GGG
gaacctttatgtctagctaa

SEQ ID NO: 9131 - DNA, 20 bp, Artificial Sequence
  Description of Artificial Sequence: Synthetic oligonucleotide
  Target: SOD1; (+) strand; PAM type: NRG; PAM sequence: CGG
gggattgtaaatgcaccaat

SEQ ID NO: 9132 - DNA, 20 bp, Artificial Sequence
  Description of Artificial Sequence: Synthetic oligonucleotide
  Target: SOD1; (+) strand; PAM type: NRG; PAM sequence: TAG
accaatcggcaccctgtgtc

SEQ ID NO: 9133 - DNA, 20 bp, Artificial Sequence
  Description of Artificial Sequence: Synthetic oligonucleotide
  Target: SOD1; (+) strand; PAM type: NRG; PAM sequence: CAG
tcggcaccctgtgtctagct

SEQ ID NO: 9134 - DNA, 20 bp, Artificial Sequence
  Description of Artificial Sequence: Synthetic oligonucleotide
  Target: SOD1; (+) strand; PAM type: NRG; PAM sequence: AGG
cggcaccctgtgtctagctc

SEQ ID NO: 9135 - DNA, 20 bp, Artificial Sequence
  Description of Artificial Sequence: Synthetic oligonucleotide
  Target: SOD1; (+) strand; PAM type: NRG; PAM sequence: GGG
ggcaccctgtgtctagctca

SEQ ID NO: 9136 - DNA, 20 bp, Artificial Sequence
  Description of Artificial Sequence: Synthetic oligonucleotide
  Target: SOD1; (+) strand; PAM type: NRG; PAM sequence: TAG
acgaatcgacactctgtatc

SEQ ID NO: 9137 - DNA, 20 bp, Artificial Sequence
  Description of Artificial Sequence: Synthetic oligonucleotide
  Target: SOD1; (+) strand; PAM type: NRG; PAM sequence: TGG
cactctgtatctagctactc

SEQ ID NO: 9138 - DNA, 20 bp, Artificial Sequence
  Description of Artificial Sequence: Synthetic oligonucleotide
  Target: SOD1; (+) strand; PAM type: NRG; PAM sequence: TGG
tctgtatctagctactctgg

SEQ ID NO: 9139 - DNA, 20 bp, Artificial Sequence
  Description of Artificial Sequence: Synthetic oligonucleotide
  Target: SOD1; (+) strand; PAM type: NRG; PAM sequence: GGG
ctgtatctagctactctggt

SEQ ID NO: 9140 - DNA, 20 bp, Artificial Sequence
  Description of Artificial Sequence: Synthetic oligonucleotide
  Target: SOD1; (+) strand; PAM type: NRG; PAM sequence: GGG
tgtatctagctactctggtg

SEQ ID NO: 9141 - DNA, 20 bp, Artificial Sequence
  Description of Artificial Sequence: Synthetic oligonucleotide
  Target: SOD1; (+) strand; PAM type: NRG; PAM sequence: GAG
tatctagctactctggtggg

SEQ ID NO: 9142 - DNA, 20 bp, Artificial Sequence
  Description of Artificial Sequence: Synthetic oligonucleotide
  Target: SOD1; (+) strand; PAM type: NRG; PAM sequence: AGG
atctagctactctggtgggg

SEQ ID NO: 9143 - DNA, 20 bp, Artificial Sequence
  Description of Artificial Sequence: Synthetic oligonucleotide
  Target: SOD1; (+) strand; PAM type: NRG; PAM sequence: TGG
tagctactctggtggggagg

SEQ ID NO: 9144 - DNA, 20 bp, Artificial Sequence
  Description of Artificial Sequence: Synthetic oligonucleotide
  Target: SOD1; (+) strand; PAM type: NRG; PAM sequence: GAG
gctactctggtggggaggtg

SEQ ID NO: 9145 - DNA, 20 bp, Artificial Sequence
  Description of Artificial Sequence: Synthetic oligonucleotide
  Target: SOD1; (+) strand; PAM type: NRG; PAM sequence: TAG
aggtggagaacctttgtgtc

SEQ ID NO: 9146 - DNA, 20 bp, Artificial Sequence
  Description of Artificial Sequence: Synthetic oligonucleotide
  Target: SOD1; (+) strand; PAM type: NRG; PAM sequence: CAG
gagaacctttgtgtctagct

SEQ ID NO: 9147 - DNA, 20 bp, Artificial Sequence
  Description of Artificial Sequence: Synthetic oligonucleotide
  Target: SOD1; (+) strand; PAM type: NRG; PAM sequence: AGG
agaacctttgtgtctagctc

SEQ ID NO: 9148 - DNA, 20 bp, Artificial Sequence
  Description of Artificial Sequence: Synthetic oligonucleotide
  Target: SOD1; (+) strand; PAM type: NRG; PAM sequence: GGG
gaacctttgtgtctagctca

SEQ ID NO: 9149 - DNA, 20 bp, Artificial Sequence
  Description of Artificial Sequence: Synthetic oligonucleotide
  Target: SOD1; (+) strand; PAM type: NRG; PAM sequence: CAG
gggattgtaaacacaccaat

SEQ ID NO: 9150 - DNA, 20 bp, Artificial Sequence
  Description of Artificial Sequence: Synthetic oligonucleotide
  Target: SOD1; (+) strand; PAM type: NRG; PAM sequence: CAG
caatcagcgccctgtcaaaa

SEQ ID NO: 9151 - DNA, 20 bp, Artificial Sequence
  Description of Artificial Sequence: Synthetic oligonucleotide
  Target: SOD1; (+) strand; PAM type: NRG; PAM sequence: CGG
ccctgtcaaaacagaccact

SEQ ID NO: 9152 - DNA, 20 bp, Artificial Sequence
  Description of Artificial Sequence: Synthetic oligonucleotide
  Target: SOD1; (+) strand; PAM type: NRG; PAM sequence: CAG
gaccactcggctctaccaat

SEQ ID NO: 9153 - DNA, 20 bp, Artificial Sequence
  Description of Artificial Sequence: Synthetic oligonucleotide
  Target: SOD1; (+) strand; PAM type: NRG; PAM sequence: CAG
cactcggctctaccaatcag

SEQ ID NO: 9154 - DNA, 20 bp, Artificial Sequence
  Description of Artificial Sequence: Synthetic oligonucleotide
  Target: SOD1; (+) strand; PAM type: NRG; PAM sequence: AGG
actcggctctaccaatcagc

SEQ ID NO: 9155 - DNA, 20 bp, Artificial Sequence
  Description of Artificial Sequence: Synthetic oligonucleotide
  Target: SOD1; (+) strand; PAM type: NRG; PAM sequence: TGG
ctctaccaatcagcaggatg

SEQ ID NO: 9156 - DNA, 20 bp, Artificial Sequence
  Description of Artificial Sequence: Synthetic oligonucleotide
  Target: SOD1; (+) strand; PAM type: NRG; PAM sequence: GGG
tctaccaatcagcaggatgt

SEQ ID NO: 9157 - DNA, 20 bp, Artificial Sequence
  Description of Artificial Sequence: Synthetic oligonucleotide
  Target: SOD1; (+) strand; PAM type: NRG; PAM sequence: TGG
accaatcagcaggatgtggg

SEQ ID NO: 9158 - DNA, 20 bp, Artificial Sequence
  Description of Artificial Sequence: Synthetic oligonucleotide
  Target: SOD1; (+) strand; PAM type: NRG; PAM sequence: GGG
ccaatcagcaggatgtgggt

SEQ ID NO: 9159 - DNA, 20 bp, Artificial Sequence
  Description of Artificial Sequence: Synthetic oligonucleotide
  Target: SOD1; (+) strand; PAM type: NRG; PAM sequence: GGG
caatcagcaggatgtgggtg

SEQ ID NO: 9160 - DNA, 20 bp, Artificial Sequence
  Description of Artificial Sequence: Synthetic oligonucleotide
  Target: SOD1; (+) strand; PAM type: NRG; PAM sequence: CAG
cagcaggatgtgggtggggc

SEQ ID NO: 9161 - DNA, 20 bp, Artificial Sequence
  Description of Artificial Sequence: Synthetic oligonucleotide
  Target: SOD1; (+) strand; PAM type: NRG; PAM sequence: AAG
atgtgggtggggccagataa

SEQ ID NO: 9162 - DNA, 20 bp, Artificial Sequence
  Description of Artificial Sequence: Synthetic oligonucleotide
  Target: SOD1; (+) strand; PAM type: NRG; PAM sequence: AAG
ggggccagataaaagaataa

SEQ ID NO: 9163 - DNA, 20 bp, Artificial Sequence
  Description of Artificial Sequence: Synthetic oligonucleotide
  Target: SOD1; (+) strand; PAM type: NRG; PAM sequence: CAG
gccagataaaagaataaaag

SEQ ID NO: 9164 - DNA, 20 bp, Artificial Sequence
  Description of Artificial Sequence: Synthetic oligonucleotide
  Target: SOD1; (+) strand; PAM type: NRG; PAM sequence: AGG
ccagataaaagaataaaagc

SEQ ID NO: 9165 - DNA, 20 bp, Artificial Sequence
  Description of Artificial Sequence: Synthetic oligonucleotide
  Target: SOD1; (+) strand; PAM type: NRG; PAM sequence: GAG
agaataaaagcaggctgcct

SEQ ID NO: 9166 - DNA, 20 bp, Artificial Sequence
  Description of Artificial Sequence: Synthetic oligonucleotide
  Target: SOD1; (+) strand; PAM type: NRG; PAM sequence: CAG
taaaagcaggctgcctgagc

SEQ ID NO: 9167 - DNA, 20 bp, Artificial Sequence
  Description of Artificial Sequence: Synthetic oligonucleotide
  Target: SOD1; (+) strand; PAM type: NRG; PAM sequence: CAG
aagcaggctgcctgagccag

SEQ ID NO: 9168 - DNA, 20 bp, Artificial Sequence
  Description of Artificial Sequence: Synthetic oligonucleotide
  Target: SOD1; (+) strand; PAM type: NRG; PAM sequence: TGG
caggctgcctgagccagcag

SEQ ID NO: 9169 - DNA, 20 bp, Artificial Sequence
  Description of Artificial Sequence: Synthetic oligonucleotide
  Target: SOD1; (+) strand; PAM type: NRG; PAM sequence: AAG
ctgcctgagccagcagtggc

SEQ ID NO: 9170 - DNA, 20 bp, Artificial Sequence
  Description of Artificial Sequence: Synthetic oligonucleotide
  Target: SOD1; (+) strand; PAM type: NRG; PAM sequence: TGG
gccagcagtggcaagctgct

SEQ ID NO: 9171 - DNA, 20 bp, Artificial Sequence
  Description of Artificial Sequence: Synthetic oligonucleotide
  Target: SOD1; (+) strand; PAM type: NRG; PAM sequence: GGG
ccagcagtggcaagctgctt

SEQ ID NO: 9172 - DNA, 20 bp, Artificial Sequence
  Description of Artificial Sequence: Synthetic oligonucleotide
  Target: SOD1; (+) strand; PAM type: NRG; PAM sequence: TGG
ttgggtccccttccatactg

SEQ ID NO: 9173 - DNA, 20 bp, Artificial Sequence
  Description of Artificial Sequence: Synthetic oligonucleotide
  Target: SOD1; (+) strand; PAM type: NRG; PAM sequence: AAG
ggtccccttccatactgtgg

SEQ ID NO: 9174 - DNA, 20 bp, Artificial Sequence
  Description of Artificial Sequence: Synthetic oligonucleotide
  Target: SOD1; (+) strand; PAM type: NRG; PAM sequence: TGG
tcttgctgctgctcactctt

SEQ ID NO: 9175 - DNA, 20 bp, Artificial Sequence
  Description of Artificial Sequence: Synthetic oligonucleotide
  Target: SOD1; (+) strand; PAM type: NRG; PAM sequence: GGG
cttgctgctgctcactcttt

SEQ ID NO: 9176 - DNA, 20 bp, Artificial Sequence
  Description of Artificial Sequence: Synthetic oligonucleotide
  Target: SOD1; (+) strand; PAM type: NRG; PAM sequence: GAG
tgggtccacactgcctttat

SEQ ID NO: 9177 - DNA, 20 bp, Artificial Sequence
  Description of Artificial Sequence: Synthetic oligonucleotide
  Target: SOD1; (+) strand; PAM type: NRG; PAM sequence: AAG
gagctgtaacactcaccacg

SEQ ID NO: 9178 - DNA, 20 bp, Artificial Sequence
  Description of Artificial Sequence: Synthetic oligonucleotide
  Target: SOD1; (+) strand; PAM type: NRG; PAM sequence: AGG
agctgtaacactcaccacga

SEQ ID NO: 9179 - DNA, 20 bp, Artificial Sequence
  Description of Artificial Sequence: Synthetic oligonucleotide
  Target: SOD1; (+) strand; PAM type: NRG; PAM sequence: CAG
acactcaccacgaaggtctg

SEQ ID NO: 9180 - DNA, 20 bp, Artificial Sequence
  Description of Artificial Sequence: Synthetic oligonucleotide
  Target: SOD1; (+) strand; PAM type: NRG; PAM sequence: AAG
ggtctgcagcttcactgctg

SEQ ID NO: 9181 - DNA, 20 bp, Artificial Sequence
  Description of Artificial Sequence: Synthetic oligonucleotide
  Target: SOD1; (+) strand; PAM type: NRG; PAM sequence: GAG
gcttcactgctgaagccaat

SEQ ID NO: 9182 - DNA, 20 bp, Artificial Sequence
  Description of Artificial Sequence: Synthetic oligonucleotide
  Target: SOD1; (+) strand; PAM type: NRG; PAM sequence: CGG
caatgagaccacgaaccccc

SEQ ID NO: 9183 - DNA, 20 bp, Artificial Sequence
  Description of Artificial Sequence: Synthetic oligonucleotide
  Target: SOD1; (+) strand; PAM type: NRG; PAM sequence: GGG
aatgagaccacgaacccccc

SEQ ID NO: 9184 - DNA, 20 bp, Artificial Sequence
  Description of Artificial Sequence: Synthetic oligonucleotide
  Target: SOD1; (+) strand; PAM type: NRG; PAM sequence: GAG
tgagaccacgaaccccccgg

SEQ ID NO: 9185 - DNA, 20 bp, Artificial Sequence
  Description of Artificial Sequence: Synthetic oligonucleotide
  Target: SOD1; (+) strand; PAM type: NRG; PAM sequence: AGG
gagaccacgaaccccccggg

SEQ ID NO: 9186 - DNA, 20 bp, Artificial Sequence
  Description of Artificial Sequence: Synthetic oligonucleotide
  Target: SOD1; (+) strand; PAM type: NRG; PAM sequence: GAG
ccgggaggaatgaacaactt

SEQ ID NO: 9187 - DNA, 20 bp, Artificial Sequence
  Description of Artificial Sequence: Synthetic oligonucleotide
  Target: SOD1; (+) strand; PAM type: NRG; PAM sequence: AAG
aacttgagacgcgctgcctt

SEQ ID NO: 9188 - DNA, 20 bp, Artificial Sequence
  Description of Artificial Sequence: Synthetic oligonucleotide
  Target: SOD1; (+) strand; PAM type: NRG; PAM sequence: GAG
cttgagacgcgctgccttaa

SEQ ID NO: 9189 - DNA, 20 bp, Artificial Sequence
  Description of Artificial Sequence: Synthetic oligonucleotide
  Target: SOD1; (+) strand; PAM type: NRG; PAM sequence: AAG
gagctgtaacactcaccgcg

SEQ ID NO: 9190 - DNA, 20 bp, Artificial Sequence
  Description of Artificial Sequence: Synthetic oligonucleotide
  Target: SOD1; (+) strand; PAM type: NRG; PAM sequence: AGG
agctgtaacactcaccgcga

SEQ ID NO: 9191 - DNA, 20 bp, Artificial Sequence
  Description of Artificial Sequence: Synthetic oligonucleotide
  Target: SOD1; (+) strand; PAM type: NRG; PAM sequence: CAG
acactcaccgcgaaggtctg

SEQ ID NO: 9192 - DNA, 20 bp, Artificial Sequence
  Description of Artificial Sequence: Synthetic oligonucleotide
  Target: SOD1; (+) strand; PAM type: NRG; PAM sequence: GAG
aggtctgcagcttcactcct

SEQ ID NO: 9193 - DNA, 20 bp, Artificial Sequence
  Description of Artificial Sequence: Synthetic oligonucleotide
  Target: SOD1; (+) strand; PAM type: NRG; PAM sequence: CAG
ctgcagcttcactcctgagc

SEQ ID NO: 9194 - DNA, 20 bp, Artificial Sequence
  Description of Artificial Sequence: Synthetic oligonucleotide
  Target: SOD1; (+) strand; PAM type: NRG; PAM sequence: GAG
agcttcactcctgagccagc

SEQ ID NO: 9195 - DNA, 20 bp, Artificial Sequence
  Description of Artificial Sequence: Synthetic oligonucleotide
  Target: SOD1; (+) strand; PAM type: NRG; PAM sequence: CAG
cagcgagaccacaaacccac

SEQ ID NO: 9196 - DNA, 20 bp, Artificial Sequence
  Description of Artificial Sequence: Synthetic oligonucleotide
  Target: SOD1; (+) strand; PAM type: NRG; PAM sequence: AAG
cgagaccacaaacccaccag

SEQ ID NO: 9197 - DNA, 20 bp, Artificial Sequence
  Description of Artificial Sequence: Synthetic oligonucleotide
  Target: SOD1; (+) strand; PAM type: NRG; PAM sequence: AGG
gagaccacaaacccaccaga

SEQ ID NO: 9198 - DNA, 20 bp, Artificial Sequence
  Description of Artificial Sequence: Synthetic oligonucleotide
  Target: SOD1; (+) strand; PAM type: NRG; PAM sequence: AAG
accacaaacccaccagaagg

SEQ ID NO: 9199 - DNA, 20 bp, Artificial Sequence
  Description of Artificial Sequence: Synthetic oligonucleotide
  Target: SOD1; (+) strand; PAM type: NRG; PAM sequence: CAG
ctccgaacacatctgaacat

SEQ ID NO: 9200 - DNA, 20 bp, Artificial Sequence
  Description of Artificial Sequence: Synthetic oligonucleotide
  Target: SOD1; (+) strand; PAM type: NRG; PAM sequence: AAG
cgaacacatctgaacatcag

SEQ ID NO: 9201 - DNA, 20 bp, Artificial Sequence
  Description of Artificial Sequence: Synthetic oligonucleotide
  Target: SOD1; (+) strand; PAM type: NRG; PAM sequence: AGG
gaacacatctgaacatcaga

SEQ ID NO: 9202 - DNA, 20 bp, Artificial Sequence
  Description of Artificial Sequence: Synthetic oligonucleotide
  Target: SOD1; (+) strand; PAM type: NRG; PAM sequence: CGG
acatcagaaggaacaaactc

SEQ ID NO: 9203 - DNA, 20 bp, Artificial Sequence
  Description of Artificial Sequence: Synthetic oligonucleotide
  Target: SOD1; (+) strand; PAM type: NRG; PAM sequence: AAG
actccggacacgccaccttt

SEQ ID NO: 9204 - DNA, 20 bp, Artificial Sequence
  Description of Artificial Sequence: Synthetic oligonucleotide
  Target: SOD1; (+) strand; PAM type: NRG; PAM sequence: GAG
agaactgtaacactcaccgc

SEQ ID NO: 9205 - DNA, 20 bp, Artificial Sequence
  Description of Artificial Sequence: Synthetic oligonucleotide
  Target: SOD1; (+) strand; PAM type: NRG; PAM sequence: AGG
gaactgtaacactcaccgcg

SEQ ID NO: 9206 - DNA, 20 bp, Artificial Sequence
  Description of Artificial Sequence: Synthetic oligonucleotide
  Target: SOD1; (+) strand; PAM type: NRG; PAM sequence: GGG
aactgtaacactcaccgcga

SEQ ID NO: 9207 - DNA, 20 bp, Artificial Sequence
  Description of Artificial Sequence: Synthetic oligonucleotide
  Target: SOD1; (+) strand; PAM type: NRG; PAM sequence: CGG
acactcaccgcgagggtcca

SEQ ID NO: 9208 - DNA, 20 bp, Artificial Sequence
  Description of Artificial Sequence: Synthetic oligonucleotide
  Target: SOD1; (+) strand; PAM type: NRG; PAM sequence: AAG
ggtccacggcttcattcttg

SEQ ID NO: 9209 - DNA, 20 bp, Artificial Sequence
  Description of Artificial Sequence: Synthetic oligonucleotide
  Target: SOD1; (+) strand; PAM type: NRG; PAM sequence: CAG
cacggcttcattcttgaagt

SEQ ID NO: 9210 - DNA, 20 bp, Artificial Sequence
  Description of Artificial Sequence: Synthetic oligonucleotide
  Target: SOD1; (+) strand; PAM type: NRG; PAM sequence: GAG
gcttcattcttgaagtcagt

SEQ ID NO: 9211 - DNA, 20 bp, Artificial Sequence
  Description of Artificial Sequence: Synthetic oligonucleotide
  Target: SOD1; (+) strand; PAM type: NRG; PAM sequence: AAG
ttcttgaagtcagtgagacc

SEQ ID NO: 9212 - DNA, 20 bp, Artificial Sequence
  Description of Artificial Sequence: Synthetic oligonucleotide
  Target: SOD1; (+) strand; PAM type: NRG; PAM sequence: CGG
gaccaagaacccaccaattc

SEQ ID NO: 9213 - DNA, 20 bp, Artificial Sequence
  Description of Artificial Sequence: Synthetic oligonucleotide
  Target: SOD1; (+) strand; PAM type: NRG; PAM sequence: CAG
cccaccaattccggacacac

SEQ ID NO: 9214 - DNA, 20 bp, Artificial Sequence
  Description of Artificial Sequence: Synthetic oligonucleotide
  Target: SOD1; (+) strand; PAM type: NRG; PAM sequence: TAG
attccggacacaccagctac

SEQ ID NO: 9215 - DNA, 20 bp, Artificial Sequence
  Description of Artificial Sequence: Synthetic oligonucleotide
  Target: SOD1; (+) strand; PAM type: NRG; PAM sequence: AGG
ttccggacacaccagctact

SEQ ID NO: 9216 - DNA, 20 bp, Artificial Sequence
  Description of Artificial Sequence: Synthetic oligonucleotide
  Target: SOD1; (+) strand; PAM type: NRG; PAM sequence: GGG
tccggacacaccagctacta

SEQ ID NO: 9217 - DNA, 20 bp, Artificial Sequence
  Description of Artificial Sequence: Synthetic oligonucleotide
  Target: SOD1; (+) strand; PAM type: NRG; PAM sequence: GAG
cggacacaccagctactagg

SEQ ID NO: 9218 - DNA, 20 bp, Artificial Sequence
  Description of Artificial Sequence: Synthetic oligonucleotide
  Target: SOD1; (+) strand; PAM type: NRG; PAM sequence: AGG
ggacacaccagctactaggg

SEQ ID NO: 9219 - DNA, 20 bp, Artificial Sequence
  Description of Artificial Sequence: Synthetic oligonucleotide
  Target: SOD1; (+) strand; PAM type: NRG; PAM sequence: GAG
caccagctactagggaggct

SEQ ID NO: 9220 - DNA, 20 bp, Artificial Sequence
  Description of Artificial Sequence: Synthetic oligonucleotide
  Target: SOD1; (+) strand; PAM type: NRG; PAM sequence: AGG
accagctactagggaggctg

SEQ ID NO: 9221 - DNA, 20 bp, Artificial Sequence
  Description of Artificial Sequence: Synthetic oligonucleotide
  Target: SOD1; (+) strand; PAM type: NRG; PAM sequence: GAG
gctactagggaggctgaggt

SEQ ID NO: 9222 - DNA, 20 bp, Artificial Sequence
  Description of Artificial Sequence: Synthetic oligonucleotide
  Target: SOD1; (+) strand; PAM type: NRG; PAM sequence: AGG
ctactagggaggctgaggtg

SEQ ID NO: 9223 - DNA, 20 bp, Artificial Sequence
  Description of Artificial Sequence: Synthetic oligonucleotide
  Target: SOD1; (+) strand; PAM type: NRG; PAM sequence: GGG
tactagggaggctgaggtga

SEQ ID NO: 9224 - DNA, 20 bp, Artificial Sequence
  Description of Artificial Sequence: Synthetic oligonucleotide
  Target: SOD1; (+) strand; PAM type: NRG; PAM sequence: GGG
actagggaggctgaggtgag

SEQ ID NO: 9225 - DNA, 20 bp, Artificial Sequence
  Description of Artificial Sequence: Synthetic oligonucleotide
  Target: SOD1; (+) strand; PAM type: NRG; PAM sequence: CAG
gtgaggggatcacctgaatc

SEQ ID NO: 9226 - DNA, 20 bp, Artificial Sequence
  Description of Artificial Sequence: Synthetic oligonucleotide
  Target: SOD1; (+) strand; PAM type: NRG; PAM sequence: AGG
tgaggggatcacctgaatcc

SEQ ID NO: 9227 - DNA, 20 bp, Artificial Sequence
  Description of Artificial Sequence: Synthetic oligonucleotide
  Target: SOD1; (+) strand; PAM type: NRG; PAM sequence: AAG
ggggatcacctgaatccagg

SEQ ID NO: 9228 - DNA, 20 bp, Artificial Sequence
  Description of Artificial Sequence: Synthetic oligonucleotide
  Target: SOD1; (+) strand; PAM type: NRG; PAM sequence: GAG
tcacctgaatccaggaagtc

SEQ ID NO: 9229 - DNA, 20 bp, Artificial Sequence
  Description of Artificial Sequence: Synthetic oligonucleotide
  Target: SOD1; (+) strand; PAM type: NRG; PAM sequence: AGG
cacctgaatccaggaagtcg

SEQ ID NO: 9230 - DNA, 20 bp, Artificial Sequence
  Description of Artificial Sequence: Synthetic oligonucleotide
  Target: SOD1; (+) strand; PAM type: NRG; PAM sequence: GGG
acctgaatccaggaagtcga

SEQ ID NO: 9231 - DNA, 20 bp, Artificial Sequence
  Description of Artificial Sequence: Synthetic oligonucleotide
  Target: SOD1; (+) strand; PAM type: NRG; PAM sequence: CAG
aatccaggaagtcgagggtg

SEQ ID NO: 9232 - DNA, 20 bp, Artificial Sequence
  Description of Artificial Sequence: Synthetic oligonucleotide
  Target: SOD1; (+) strand; PAM type: NRG; PAM sequence: GAG
caggaagtcgagggtgcagt

SEQ ID NO: 9233 - DNA, 20 bp, Artificial Sequence
  Description of Artificial Sequence: Synthetic oligonucleotide
  Target: SOD1; (+) strand; PAM type: NRG; PAM sequence: GAG
agtcgagggtgcagtgagcc

SEQ ID NO: 9234 - DNA, 20 bp, Artificial Sequence
  Description of Artificial Sequence: Synthetic oligonucleotide
  Target: SOD1; (+) strand; PAM type: NRG; PAM sequence: CAG
gagatcatgccgttacactc

SEQ ID NO: 9235 - DNA, 20 bp, Artificial Sequence
  Description of Artificial Sequence: Synthetic oligonucleotide
  Target: SOD1; (+) strand; PAM type: NRG; PAM sequence: GAG
atgccgttacactccagcct

SEQ ID NO: 9236 - DNA, 20 bp, Artificial Sequence
  Description of Artificial Sequence: Synthetic oligonucleotide
  Target: SOD1; (+) strand; PAM type: NRG; PAM sequence: CAG
ttacactccagcctgagtga

SEQ ID NO: 9237 - DNA, 20 bp, Artificial Sequence
  Description of Artificial Sequence: Synthetic oligonucleotide
  Target: SOD1; (+) strand; PAM type: NRG; PAM sequence: GAG
acactccagcctgagtgaca

SEQ ID NO: 9238 - DNA, 20 bp, Artificial Sequence
  Description of Artificial Sequence: Synthetic oligonucleotide
  Target: SOD1; (+) strand; PAM type: NRG; PAM sequence: GAG
tccagcctgagtgacagagt

SEQ ID NO: 9239 - DNA, 20 bp, Artificial Sequence
  Description of Artificial Sequence: Synthetic oligonucleotide
  Target: SOD1; (+) strand; PAM type: NRG; PAM sequence: CAG
gagatcttgtgtcaaaaaaa

SEQ ID NO: 9240 - DNA, 20 bp, Artificial Sequence
  Description of Artificial Sequence: Synthetic oligonucleotide
  Target: SOD1; (+) strand; PAM type: NRG; PAM sequence: AAG
aaaacagaacaaaataaaac

SEQ ID NO: 9241 - DNA, 20 bp, Artificial Sequence
  Description of Artificial Sequence: Synthetic oligonucleotide
  Target: SOD1; (+) strand; PAM type: NRG; PAM sequence: TAG
aataaaacaagaacgttgaa

SEQ ID NO: 9242 - DNA, 20 bp, Artificial Sequence
  Description of Artificial Sequence: Synthetic oligonucleotide
  Target: SOD1; (+) strand; PAM type: NRG; PAM sequence: AGG
ataaaacaagaacgttgaat

SEQ ID NO: 9243 - DNA, 20 bp, Artificial Sequence
  Description of Artificial Sequence: Synthetic oligonucleotide
  Target: SOD1; (+) strand; PAM type: NRG; PAM sequence: GAG
ataggctgtgtgttaattct

SEQ ID NO: 9244 - DNA, 20 bp, Artificial Sequence
  Description of Artificial Sequence: Synthetic oligonucleotide
  Target: SOD1; (+) strand; PAM type: NRG; PAM sequence: TGG
gctgtgtgttaattctgaga

SEQ ID NO: 9245 - DNA, 20 bp, Artificial Sequence
  Description of Artificial Sequence: Synthetic oligonucleotide
  Target: SOD1; (+) strand; PAM type: NRG; PAM sequence: GAG
tgtgtgttaattctgagatg

SEQ ID NO: 9246 - DNA, 20 bp, Artificial Sequence
  Description of Artificial Sequence: Synthetic oligonucleotide
  Target: SOD1; (+) strand; PAM type: NRG; PAM sequence: CAG
gttaattctgagatggagtc

SEQ ID NO: 9247 - DNA, 20 bp, Artificial Sequence
  Description of Artificial Sequence: Synthetic oligonucleotide
  Target: SOD1; (+) strand; PAM type: NRG; PAM sequence: AAG
ctgagatggagtccagactt

SEQ ID NO: 9248 - DNA, 20 bp, Artificial Sequence
  Description of Artificial Sequence: Synthetic oligonucleotide
  Target: SOD1; (+) strand; PAM type: NRG; PAM sequence: GAG
ccagacttaagaatgatcct

SEQ ID NO: 9249 - DNA, 20 bp, Artificial Sequence
  Description of Artificial Sequence: Synthetic oligonucleotide
  Target: SOD1; (+) strand; PAM type: NRG; PAM sequence: AGG
cagacttaagaatgatcctg

SEQ ID NO: 9250 - DNA, 20 bp, Artificial Sequence
  Description of Artificial Sequence: Synthetic oligonucleotide
  Target: SOD1; (+) strand; PAM type: NRG; PAM sequence: TAG
ttaagaatgatcctgaggct

SEQ ID NO: 9251 - DNA, 20 bp, Artificial Sequence
  Description of Artificial Sequence: Synthetic oligonucleotide
  Target: SOD1; (+) strand; PAM type: NRG; PAM sequence: AAG
tgaggcttagacccatatcc

SEQ ID NO: 9252 - DNA, 20 bp, Artificial Sequence
  Description of Artificial Sequence: Synthetic oligonucleotide
  Target: SOD1; (+) strand; PAM type: NRG; PAM sequence: GAG
aggcttagacccatatccaa

SEQ ID NO: 9253 - DNA, 20 bp, Artificial Sequence
  Description of Artificial Sequence: Synthetic oligonucleotide
  Target: SOD1; (+) strand; PAM type: NRG; PAM sequence: AGG
ggcttagacccatatccaag

SEQ ID NO: 9254 - DNA, 20 bp, Artificial Sequence
  Description of Artificial Sequence: Synthetic oligonucleotide
  Target: SOD1; (+) strand; PAM type: NRG; PAM sequence: CAG
catatccaagaggatgattc

SEQ ID NO: 9255 - DNA, 20 bp, Artificial Sequence
  Description of Artificial Sequence: Synthetic oligonucleotide
  Target: SOD1; (+) strand; PAM type: NRG; PAM sequence: TGG
ccaagaggatgattccagcc

SEQ ID NO: 9256 - DNA, 20 bp, Artificial Sequence
  Description of Artificial Sequence: Synthetic oligonucleotide
  Target: SOD1; (+) strand; PAM type: NRG; PAM sequence: TAG
tgattccagcctggcactta

SEQ ID NO: 9257 - DNA, 20 bp, Artificial Sequence
  Description of Artificial Sequence: Synthetic oligonucleotide
  Target: SOD1; (+) strand; PAM type: NRG; PAM sequence: AGG
gattccagcctggcacttat

SEQ ID NO: 9258 - DNA, 20 bp, Artificial Sequence
  Description of Artificial Sequence: Synthetic oligonucleotide
  Target: SOD1; (+) strand; PAM type: NRG; PAM sequence: CAG
cctggcacttataggttctt

SEQ ID NO: 9259 - DNA, 20 bp, Artificial Sequence
  Description of Artificial Sequence: Synthetic oligonucleotide
  Target: SOD1; (+) strand; PAM type: NRG; PAM sequence: AGG
ctggcacttataggttcttc

SEQ ID NO: 9260 - DNA, 20 bp, Artificial Sequence
  Description of Artificial Sequence: Synthetic oligonucleotide
  Target: SOD1; (+) strand; PAM type: NRG; PAM sequence: CAG
tataggttcttcaggcactt

SEQ ID NO: 9261 - DNA, 20 bp, Artificial Sequence
  Description of Artificial Sequence: Synthetic oligonucleotide
  Target: SOD1; (+) strand; PAM type: NRG; PAM sequence: AAG
gatgcaccctgtcctgaatt

SEQ ID NO: 9262 - DNA, 20 bp, Artificial Sequence
  Description of Artificial Sequence: Synthetic oligonucleotide
  Target: SOD1; (+) strand; PAM type: NRG; PAM sequence: TGG
gtccttgaacctgctttcct

SEQ ID NO: 9263 - DNA, 20 bp, Artificial Sequence
  Description of Artificial Sequence: Synthetic oligonucleotide
  Target: SOD1; (+) strand; PAM type: NRG; PAM sequence: CAG
aacctgctttccttggtaaa

SEQ ID NO: 9264 - DNA, 20 bp, Artificial Sequence
  Description of Artificial Sequence: Synthetic oligonucleotide
  Target: SOD1; (+) strand; PAM type: NRG; PAM sequence: AAG
tttccttggtaaacagcacc

SEQ ID NO: 9265 - DNA, 20 bp, Artificial Sequence
  Description of Artificial Sequence: Synthetic oligonucleotide
  Target: SOD1; (+) strand; PAM type: NRG; PAM sequence: AGG
ttccttggtaaacagcacca

SEQ ID NO: 9266 - DNA, 20 bp, Artificial Sequence
  Description of Artificial Sequence: Synthetic oligonucleotide
  Target: SOD1; (+) strand; PAM type: NRG; PAM sequence: GGG
tccttggtaaacagcaccaa

SEQ ID NO: 9267 - DNA, 20 bp, Artificial Sequence
  Description of Artificial Sequence: Synthetic oligonucleotide
  Target: SOD1; (+) strand; PAM type: NRG; PAM sequence: GGG
ccttggtaaacagcaccaag

SEQ ID NO: 9268 - DNA, 20 bp, Artificial Sequence
  Description of Artificial Sequence: Synthetic oligonucleotide
  Target: SOD1; (+) strand; PAM type: NRG; PAM sequence: GGG
cttggtaaacagcaccaagg

SEQ ID NO: 9269 - DNA, 20 bp, Artificial Sequence
  Description of Artificial Sequence: Synthetic oligonucleotide
  Target: SOD1; (+) strand; PAM type: NRG; PAM sequence: TAG
gtaaacagcaccaagggggc

SEQ ID NO: 9270 - DNA, 20 bp, Artificial Sequence
  Description of Artificial Sequence: Synthetic oligonucleotide
  Target: SOD1; (+) strand; PAM type: NRG; PAM sequence: TGG
caccaagggggctagaaacc

SEQ ID NO: 9271 - DNA, 20 bp, Artificial Sequence
  Description of Artificial Sequence: Synthetic oligonucleotide
  Target: SOD1; (+) strand; PAM type: NRG; PAM sequence: GGG
accaagggggctagaaacct

SEQ ID NO: 9272 - DNA, 20 bp, Artificial Sequence
  Description of Artificial Sequence: Synthetic oligonucleotide
  Target: SOD1; (+) strand; PAM type: NRG; PAM sequence: GGG
ccaagggggctagaaacctg

SEQ ID NO: 9273 - DNA, 20 bp, Artificial Sequence
  Description of Artificial Sequence: Synthetic oligonucleotide
  Target: SOD1; (+) strand; PAM type: NRG; PAM sequence: GGG
caagggggctagaaacctgg

SEQ ID NO: 9274 - DNA, 20 bp, Artificial Sequence
  Description of Artificial Sequence: Synthetic oligonucleotide
  Target: SOD1; (+) strand; PAM type: NRG; PAM sequence: TGG
ctctcaccatgcacctctaa

SEQ ID NO: 9275 - DNA, 20 bp, Artificial Sequence
  Description of Artificial Sequence: Synthetic oligonucleotide
  Target: SOD1; (+) strand; PAM type: NRG; PAM sequence: GGG
tctcaccatgcacctctaat

SEQ ID NO: 9276 - DNA, 20 bp, Artificial Sequence
  Description of Artificial Sequence: Synthetic oligonucleotide
  Target: SOD1; (+) strand; PAM type: NRG; PAM sequence: TGG
caccatgcacctctaatggg

SEQ ID NO: 9277 - DNA, 20 bp, Artificial Sequence
  Description of Artificial Sequence: Synthetic oligonucleotide
  Target: SOD1; (+) strand; PAM type: NRG; PAM sequence: TGG
atgcacctctaatgggtggc

SEQ ID NO: 9278 - DNA, 20 bp, Artificial Sequence
  Description of Artificial Sequence: Synthetic oligonucleotide
  Target: SOD1; (+) strand; PAM type: NRG; PAM sequence: TGG
ctaatgggtggctggacttg

SEQ ID NO: 9279 - DNA, 20 bp, Artificial Sequence
  Description of Artificial Sequence: Synthetic oligonucleotide
  Target: SOD1; (+) strand; PAM type: NRG; PAM sequence: CAG
gttgcatttccgtgatctcc

SEQ ID NO: 9280 - DNA, 20 bp, Artificial Sequence
  Description of Artificial Sequence: Synthetic oligonucleotide
  Target: SOD1; (+) strand; PAM type: NRG; PAM sequence: CAG
gtgatctcccagctttcttc

SEQ ID NO: 9281 - DNA, 20 bp, Artificial Sequence
  Description of Artificial Sequence: Synthetic oligonucleotide
  Target: SOD1; (+) strand; PAM type: NRG; PAM sequence: TGG
tcccagctttcttccagtga

SEQ ID NO: 9282 - DNA, 20 bp, Artificial Sequence
  Description of Artificial Sequence: Synthetic oligonucleotide
  Target: SOD1; (+) strand; PAM type: NRG; PAM sequence: TAG
ctttcttccagtgatggcct

SEQ ID NO: 9283 - DNA, 20 bp, Artificial Sequence
  Description of Artificial Sequence: Synthetic oligonucleotide
  Target: SOD1; (+) strand; PAM type: NRG; PAM sequence: AGG
tttcttccagtgatggcctt

SEQ ID NO: 9284 - DNA, 20 bp, Artificial Sequence
  Description of Artificial Sequence: Synthetic oligonucleotide
  Target: SOD1; (+) strand; PAM type: NRG; PAM sequence: TGG
cttccagtgatggccttagg

SEQ ID NO: 9285 - DNA, 20 bp, Artificial Sequence
  Description of Artificial Sequence: Synthetic oligonucleotide
  Target: SOD1; (+) strand; PAM type: NRG; PAM sequence: GGG
ttccagtgatggccttaggt

SEQ ID NO: 9286 - DNA, 20 bp, Artificial Sequence
  Description of Artificial Sequence: Synthetic oligonucleotide
  Target: SOD1; (+) strand; PAM type: NRG; PAM sequence: TGG
ctcttatcctgtctcccaaa

SEQ ID NO: 9287 - DNA, 20 bp, Artificial Sequence
  Description of Artificial Sequence: Synthetic oligonucleotide
  Target: SOD1; (+) strand; PAM type: NRG; PAM sequence: GAG
ccaaatggcctctctgcctt

SEQ ID NO: 9288 - DNA, 20 bp, Artificial Sequence
  Description of Artificial Sequence: Synthetic oligonucleotide
  Target: SOD1; (+) strand; PAM type: NRG; PAM sequence: CAG
agtctcaccccatctgctct

SEQ ID NO: 9289 - DNA, 20 bp, Artificial Sequence
  Description of Artificial Sequence: Synthetic oligonucleotide
  Target: SOD1; (+) strand; PAM type: NRG; PAM sequence: GAG
ctgctctcagtccacccact

SEQ ID NO: 9290 - DNA, 20 bp, Artificial Sequence
  Description of Artificial Sequence: Synthetic oligonucleotide
  Target: SOD1; (+) strand; PAM type: NRG; PAM sequence: CAG
gtccacccactgagctattc

SEQ ID NO: 9291 - DNA, 20 bp, Artificial Sequence
  Description of Artificial Sequence: Synthetic oligonucleotide
  Target: SOD1; (+) strand; PAM type: NRG; PAM sequence: GAG
ccacccactgagctattcca

SEQ ID NO: 9292 - DNA, 20 bp, Artificial Sequence
  Description of Artificial Sequence: Synthetic oligonucleotide
  Target: SOD1; (+) strand; PAM type: NRG; PAM sequence: TGG
gagaccattctgactccctg

SEQ ID NO: 9293 - DNA, 20 bp, Artificial Sequence
  Description of Artificial Sequence: Synthetic oligonucleotide
  Target: SOD1; (+) strand; PAM type: NRG; PAM sequence: TGG
actccctgtggacacccctc

SEQ ID NO: 9294 - DNA, 20 bp, Artificial Sequence
  Description of Artificial Sequence: Synthetic oligonucleotide
  Target: SOD1; (+) strand; PAM type: NRG; PAM sequence: TGG
ccctgtggacacccctctgg

SEQ ID NO: 9295 - DNA, 20 bp, Artificial Sequence
  Description of Artificial Sequence: Synthetic oligonucleotide
  Target: SOD1; (+) strand; PAM type: NRG; PAM sequence: CAG
tggtggcttctcctctctgt

SEQ ID NO: 9296 - DNA, 20 bp, Artificial Sequence
  Description of Artificial Sequence: Synthetic oligonucleotide
  Target: SOD1; (+) strand; PAM type: NRG; PAM sequence: TAG
ggcttctcctctctgtcagt

SEQ ID NO: 9297 - DNA, 20 bp, Artificial Sequence
  Description of Artificial Sequence: Synthetic oligonucleotide
  Target: SOD1; (+) strand; PAM type: NRG; PAM sequence: TGG
ttgactgcatgtaacaaatg

SEQ ID NO: 9298 - DNA, 20 bp, Artificial Sequence
  Description of Artificial Sequence: Synthetic oligonucleotide
  Target: SOD1; (+) strand; PAM type: NRG; PAM sequence: AAG
ttacgctatttaaccaaata

SEQ ID NO: 9299 - DNA, 20 bp, Artificial Sequence
  Description of Artificial Sequence: Synthetic oligonucleotide
  Target: SOD1; (+) strand; PAM type: NRG; PAM sequence: AGG
tacgctatttaaccaaataa

SEQ ID NO: 9300 - DNA, 20 bp, Artificial Sequence
  Description of Artificial Sequence: Synthetic oligonucleotide
  Target: SOD1; (+) strand; PAM type: NRG; PAM sequence: AAG
tttatttttctcgtgatgaa

SEQ ID NO: 9301 - DNA, 20 bp, Artificial Sequence
  Description of Artificial Sequence: Synthetic oligonucleotide
  Target: SOD1; (+) strand; PAM type: NRG; PAM sequence: CAG
ttctcgtgatgaaaagtaca

SEQ ID NO: 9302 - DNA, 20 bp, Artificial Sequence
  Description of Artificial Sequence: Synthetic oligonucleotide
  Target: SOD1; (+) strand; PAM type: NRG; PAM sequence: AAG
gtgatgaaaagtacacagat

SEQ ID NO: 9303 - DNA, 20 bp, Artificial Sequence
  Description of Artificial Sequence: Synthetic oligonucleotide
  Target: SOD1; (+) strand; PAM type: NRG; PAM sequence: CAG
atgaaaagtacacagataag

SEQ ID NO: 9304 - DNA, 20 bp, Artificial Sequence
  Description of Artificial Sequence: Synthetic oligonucleotide
  Target: SOD1; (+) strand; PAM type: NRG; PAM sequence: GAG
tacttccatcgataaccatt

SEQ ID NO: 9305 - DNA, 20 bp, Artificial Sequence
  Description of Artificial Sequence: Synthetic oligonucleotide
  Target: SOD1; (+) strand; PAM type: NRG; PAM sequence: AGG
acttccatcgataaccattg

SEQ ID NO: 9306 - DNA, 20 bp, Artificial Sequence
  Description of Artificial Sequence: Synthetic oligonucleotide
  Target: SOD1; (+) strand; PAM type: NRG; PAM sequence: GGG
cttccatcgataaccattga

SEQ ID NO: 9307 - DNA, 20 bp, Artificial Sequence
  Description of Artificial Sequence: Synthetic oligonucleotide
  Target: SOD1; (+) strand; PAM type: NRG; PAM sequence: CAG
agggtttcttatgactctta

SEQ ID NO: 9308 - DNA, 20 bp, Artificial Sequence
  Description of Artificial Sequence: Synthetic oligonucleotide
  Target: SOD1; (+) strand; PAM type: NRG; PAM sequence: CAG
agcaatgaaatgtgtattta

SEQ ID NO: 9309 - DNA, 20 bp, Artificial Sequence
  Description of Artificial Sequence: Synthetic oligonucleotide
  Target: SOD1; (+) strand; PAM type: NRG; PAM sequence: AAG
aaatgtgtatttacagtata

SEQ ID NO: 9310 - DNA, 20 bp, Artificial Sequence
  Description of Artificial Sequence: Synthetic oligonucleotide
  Target: SOD1; (+) strand; PAM type: NRG; PAM sequence: AAG
gtataaagatatacaatttt

SEQ ID NO: 9311 - DNA, 20 bp, Artificial Sequence
  Description of Artificial Sequence: Synthetic oligonucleotide
  Target: SOD1; (+) strand; PAM type: NRG; PAM sequence: AGG
tataaagatatacaatttta

SEQ ID NO: 9312 - DNA, 20 bp, Artificial Sequence
  Description of Artificial Sequence: Synthetic oligonucleotide
  Target: SOD1; (+) strand; PAM type: NRG; PAM sequence: TGG
ttttaaggttttaatataat

SEQ ID NO: 9313 - DNA, 20 bp, Artificial Sequence
  Description of Artificial Sequence: Synthetic oligonucleotide
  Target: SOD1; (+) strand; PAM type: NRG; PAM sequence: GGG
tttaaggttttaatataatt

SEQ ID NO: 9314 - DNA, 20 bp, Artificial Sequence
  Description of Artificial Sequence: Synthetic oligonucleotide
  Target: SOD1; (+) strand; PAM type: NRG; PAM sequence: AAG
gttttaatataattgggcct

SEQ ID NO: 9315 - DNA, 20 bp, Artificial Sequence
  Description of Artificial Sequence: Synthetic oligonucleotide
  Target: SOD1; (+) strand; PAM type: NRG; PAM sequence: CAG
aatataattgggcctaagca

SEQ ID NO: 9316 - DNA, 20 bp, Artificial Sequence
  Description of Artificial Sequence: Synthetic oligonucleotide
  Target: SOD1; (+) strand; PAM type: NRG; PAM sequence: TAG
aagcacagtattttttgttt

SEQ ID NO: 9317 - DNA, 20 bp, Artificial Sequence
  Description of Artificial Sequence: Synthetic oligonucleotide
  Target: SOD1; (+) strand; PAM type: NRG; PAM sequence: CAG
tgttttagttttcaactgcc

SEQ ID NO: 9318 - DNA, 20 bp, Artificial Sequence
  Description of Artificial Sequence: Synthetic oligonucleotide
  Target: SOD1; (+) strand; PAM type: NRG; PAM sequence: AGG
gttttagttttcaactgccc

SEQ ID NO: 9319 - DNA, 20 bp, Artificial Sequence
  Description of Artificial Sequence: Synthetic oligonucleotide
  Target: SOD1; (+) strand; PAM type: NRG; PAM sequence: CAG
gcccaggtgattctattgtg

SEQ ID NO: 9320 - DNA, 20 bp, Artificial Sequence
  Description of Artificial Sequence: Synthetic oligonucleotide
  Target: SOD1; (+) strand; PAM type: NRG; PAM sequence: CAG
aggtgattctattgtgcagc

SEQ ID NO: 9321 - DNA, 20 bp, Artificial Sequence
  Description of Artificial Sequence: Synthetic oligonucleotide
  Target: SOD1; (+) strand; PAM type: NRG; PAM sequence: AGG
ggtgattctattgtgcagcc

SEQ ID NO: 9322 - DNA, 20 bp, Artificial Sequence
  Description of Artificial Sequence: Synthetic oligonucleotide
  Target: SOD1; (+) strand; PAM type: NRG; PAM sequence: GGG
gtgattctattgtgcagcca

SEQ ID NO: 9323 - DNA, 20 bp, Artificial Sequence
  Description of Artificial Sequence: Synthetic oligonucleotide
  Target: SOD1; (+) strand; PAM type: NRG; PAM sequence: TAG
gggttgataaacactgcatc

SEQ ID NO: 9324 - DNA, 20 bp, Artificial Sequence
  Description of Artificial Sequence: Synthetic oligonucleotide
  Target: SOD1; (+) strand; PAM type: NRG; PAM sequence: AGG
ggttgataaacactgcatct

SEQ ID NO: 9325 - DNA, 20 bp, Artificial Sequence
  Description of Artificial Sequence: Synthetic oligonucleotide
  Target: SOD1; (+) strand; PAM type: NRG; PAM sequence: CAG
ataaacactgcatctaggcc

SEQ ID NO: 9326 - DNA, 20 bp, Artificial Sequence
  Description of Artificial Sequence: Synthetic oligonucleotide
  Target: SOD1; (+) strand; PAM type: NRG; PAM sequence: CAG
ggcccagtgcctttgatttg

SEQ ID NO: 9327 - DNA, 20 bp, Artificial Sequence
  Description of Artificial Sequence: Synthetic oligonucleotide
  Target: SOD1; (+) strand; PAM type: NRG; PAM sequence: GAG
agtgcctttgatttgcagct

SEQ ID NO: 9328 - DNA, 20 bp, Artificial Sequence
  Description of Artificial Sequence: Synthetic oligonucleotide
  Target: SOD1; (+) strand; PAM type: NRG; PAM sequence: AGG
gtgcctttgatttgcagctg

SEQ ID NO: 9329 - DNA, 20 bp, Artificial Sequence
  Description of Artificial Sequence: Synthetic oligonucleotide
  Target: SOD1; (+) strand; PAM type: NRG; PAM sequence: TAG
tttgatttgcagctgaggtc

SEQ ID NO: 9330 - DNA, 20 bp, Artificial Sequence
  Description of Artificial Sequence: Synthetic oligonucleotide
  Target: SOD1; (+) strand; PAM type: NRG; PAM sequence: GAG
tgatttgcagctgaggtcta

SEQ ID NO: 9331 - DNA, 20 bp, Artificial Sequence
  Description of Artificial Sequence: Synthetic oligonucleotide
  Target: SOD1; (+) strand; PAM type: NRG; PAM sequence: GAG
atttgcagctgaggtctaga

SEQ ID NO: 9332 - DNA, 20 bp, Artificial Sequence
  Description of Artificial Sequence: Synthetic oligonucleotide
  Target: SOD1; (+) strand; PAM type: NRG; PAM sequence: CAG
agagagaattattgaaactg

SEQ ID NO: 9333 - DNA, 20 bp, Artificial Sequence
  Description of Artificial Sequence: Synthetic oligonucleotide
  Target: SOD1; (+) strand; PAM type: NRG; PAM sequence: CAG
aattattgaaactgcagtcc

SEQ ID NO: 9334 - DNA, 20 bp, Artificial Sequence
  Description of Artificial Sequence: Synthetic oligonucleotide
  Target: SOD1; (+) strand; PAM type: NRG; PAM sequence: TGG
aaactgcagtcccagctact

SEQ ID NO: 9335 - DNA, 20 bp, Artificial Sequence
  Description of Artificial Sequence: Synthetic oligonucleotide
  Target: SOD1; (+) strand; PAM type: NRG; PAM sequence: GGG
aactgcagtcccagctactt

SEQ ID NO: 9336 - DNA, 20 bp, Artificial Sequence
  Description of Artificial Sequence: Synthetic oligonucleotide
  Target: SOD1; (+) strand; PAM type: NRG; PAM sequence: GAG
ctgcagtcccagctacttgg

SEQ ID NO: 9337 - DNA, 20 bp, Artificial Sequence
  Description of Artificial Sequence: Synthetic oligonucleotide
  Target: SOD1; (+) strand; PAM type: NRG; PAM sequence: AGG
tgcagtcccagctacttggg

SEQ ID NO: 9338 - DNA, 20 bp, Artificial Sequence
  Description of Artificial Sequence: Synthetic oligonucleotide
  Target: SOD1; (+) strand; PAM type: NRG; PAM sequence: GAG
tcccagctacttgggaggct

SEQ ID NO: 9339 - DNA, 20 bp, Artificial Sequence
  Description of Artificial Sequence: Synthetic oligonucleotide
  Target: SOD1; (+) strand; PAM type: NRG; PAM sequence: AGG
cccagctacttgggaggctg

SEQ ID NO: 9340 - DNA, 20 bp, Artificial Sequence
  Description of Artificial Sequence: Synthetic oligonucleotide
  Target: SOD1; (+) strand; PAM type: NRG; PAM sequence: TGG
gctacttgggaggctgaggt

SEQ ID NO: 9341 - DNA, 20 bp, Artificial Sequence
  Description of Artificial Sequence: Synthetic oligonucleotide
  Target: SOD1; (+) strand; PAM type: NRG; PAM sequence: GAG
tacttgggaggctgaggttg

SEQ ID NO: 9342 - DNA, 20 bp, Artificial Sequence
  Description of Artificial Sequence: Synthetic oligonucleotide
  Target: SOD1; (+) strand; PAM type: NRG; PAM sequence: AAG
ctgaggttggagaattgcct

SEQ ID NO: 9343 - DNA, 20 bp, Artificial Sequence
  Description of Artificial Sequence: Synthetic oligonucleotide
  Target: SOD1; (+) strand; PAM type: NRG; PAM sequence: CAG
gttggagaattgcctaagcc

SEQ ID NO: 9344 - DNA, 20 bp, Artificial Sequence
  Description of Artificial Sequence: Synthetic oligonucleotide
  Target: SOD1; (+) strand; PAM type: NRG; PAM sequence: CGG
ggagaattgcctaagcccag

SEQ ID NO: 9345 - DNA, 20 bp, Artificial Sequence
  Description of Artificial Sequence: Synthetic oligonucleotide
  Target: SOD1; (+) strand; PAM type: NRG; PAM sequence: GGG
gagaattgcctaagcccagc

SEQ ID NO: 9346 - DNA, 20 bp, Artificial Sequence
  Description of Artificial Sequence: Synthetic oligonucleotide
  Target: SOD1; (+) strand; PAM type: NRG; PAM sequence: GGG
agaattgcctaagcccagcg

SEQ ID NO: 9347 - DNA, 20 bp, Artificial Sequence
  Description of Artificial Sequence: Synthetic oligonucleotide
  Target: SOD1; (+) strand; PAM type: NRG; PAM sequence: GAG
ttgcctaagcccagcggggt

SEQ ID NO: 9348 - DNA, 20 bp, Artificial Sequence
  Description of Artificial Sequence: Synthetic oligonucleotide
  Target: SOD1; (+) strand; PAM type: NRG; PAM sequence: AGG
tgcctaagcccagcggggtg

SEQ ID NO: 9349 - DNA, 20 bp, Artificial Sequence
  Description of Artificial Sequence: Synthetic oligonucleotide
  Target: SOD1; (+) strand; PAM type: NRG; PAM sequence: TAG
agcccagcggggtgaggctg

SEQ ID NO: 9350 - DNA, 20 bp, Artificial Sequence
  Description of Artificial Sequence: Synthetic oligonucleotide
  Target: SOD1; (+) strand; PAM type: NRG; PAM sequence: GAG
cagcggggtgaggctgtagt

SEQ ID NO: 9351 - DNA, 20 bp, Artificial Sequence
  Description of Artificial Sequence: Synthetic oligonucleotide
  Target: SOD1; (+) strand; PAM type: NRG; PAM sequence: AAG
gggtgaggctgtagtgagtc

SEQ ID NO: 9352 - DNA, 20 bp, Artificial Sequence
  Description of Artificial Sequence: Synthetic oligonucleotide
  Target: SOD1; (+) strand; PAM type: NRG; PAM sequence: CAG
aagactgcaccaccgcactc

SEQ ID NO: 9353 - DNA, 20 bp, Artificial Sequence
  Description of Artificial Sequence: Synthetic oligonucleotide
  Target: SOD1; (+) strand; PAM type: NRG; PAM sequence: CGG
tgcaccaccgcactccagcc

SEQ ID NO: 9354 - DNA, 20 bp, Artificial Sequence
  Description of Artificial Sequence: Synthetic oligonucleotide
  Target: SOD1; (+) strand; PAM type: NRG; PAM sequence: GGG
gcaccaccgcactccagccc

SEQ ID NO: 9355 - DNA, 20 bp, Artificial Sequence
  Description of Artificial Sequence: Synthetic oligonucleotide
  Target: SOD1; (+) strand; PAM type: NRG; PAM sequence: CAG
ccgcactccagcccgggcga

SEQ ID NO: 9356 - DNA, 20 bp, Artificial Sequence
  Description of Artificial Sequence: Synthetic oligonucleotide
  Target: SOD1; (+) strand; PAM type: NRG; PAM sequence: GAG
gcactccagcccgggcgaca

SEQ ID NO: 9357 - DNA, 20 bp, Artificial Sequence
  Description of Artificial Sequence: Synthetic oligonucleotide
  Target: SOD1; (+) strand; PAM type: NRG; PAM sequence: TGG
tctaaaaaaaaaaaaatttc

SEQ ID NO: 9358 - DNA, 20 bp, Artificial Sequence
  Description of Artificial Sequence: Synthetic oligonucleotide
  Target: SOD1; (+) strand; PAM type: NRG; PAM sequence: CAG
ttttgcccaccttttaacca

SEQ ID NO: 9359 - DNA, 20 bp, Artificial Sequence
  Description of Artificial Sequence: Synthetic oligonucleotide
  Target: SOD1; (+) strand; PAM type: NRG; PAM sequence: GAG
ttgcccaccttttaaccaca

SEQ ID NO: 9360 - DNA, 20 bp, Artificial Sequence
  Description of Artificial Sequence: Synthetic oligonucleotide
  Target: SOD1; (+) strand; PAM type: NRG; PAM sequence: AGG
tgcccaccttttaaccacag

SEQ ID NO: 9361 - DNA, 20 bp, Artificial Sequence
  Description of Artificial Sequence: Synthetic oligonucleotide
  Target: SOD1; (+) strand; PAM type: NRG; PAM sequence: CAG
caaacatgaattttcactct

SEQ ID NO: 9362 - DNA, 20 bp, Artificial Sequence
  Description of Artificial Sequence: Synthetic oligonucleotide
  Target: SOD1; (+) strand; PAM type: NRG; PAM sequence: AGG
aaacatgaattttcactctc

SEQ ID NO: 9363 - DNA, 20 bp, Artificial Sequence
  Description of Artificial Sequence: Synthetic oligonucleotide
  Target: SOD1; (+) strand; PAM type: NRG; PAM sequence: AAG
catgaattttcactctcagg

SEQ ID NO: 9364 - DNA, 20 bp, Artificial Sequence
  Description of Artificial Sequence: Synthetic oligonucleotide
  Target: SOD1; (+) strand; PAM type: NRG; PAM sequence: AGG
atgaattttcactctcagga

SEQ ID NO: 9365 - DNA, 20 bp, Artificial Sequence
  Description of Artificial Sequence: Synthetic oligonucleotide
  Target: SOD1; (+) strand; PAM type: NRG; PAM sequence: AAG
aggctgaaatgacacattac

SEQ ID NO: 9366 - DNA, 20 bp, Artificial Sequence
  Description of Artificial Sequence: Synthetic oligonucleotide
  Target: SOD1; (+) strand; PAM type: NRG; PAM sequence: CGG
ctgaaatgacacattacaag

SEQ ID NO: 9367 - DNA, 20 bp, Artificial Sequence
  Description of Artificial Sequence: Synthetic oligonucleotide
  Target: SOD1; (+) strand; PAM type: NRG; PAM sequence: TAG
atgacacattacaagcggtt

SEQ ID NO: 9368 - DNA, 20 bp, Artificial Sequence
  Description of Artificial Sequence: Synthetic oligonucleotide
  Target: SOD1; (+) strand; PAM type: NRG; PAM sequence: AAG
cacgtgccgccatctgattt

SEQ ID NO: 9369 - DNA, 20 bp, Artificial Sequence
  Description of Artificial Sequence: Synthetic oligonucleotide
  Target: SOD1; (+) strand; PAM type: NRG; PAM sequence: AGG
acgtgccgccatctgattta

SEQ ID NO: 9370 - DNA, 20 bp, Artificial Sequence
  Description of Artificial Sequence: Synthetic oligonucleotide
  Target: SOD1; (+) strand; PAM type: NRG; PAM sequence: AAG
cctcctcaccattcctgaca

SEQ ID NO: 9371 - DNA, 20 bp, Artificial Sequence
  Description of Artificial Sequence: Synthetic oligonucleotide
  Target: SOD1; (+) strand; PAM type: NRG; PAM sequence: CAG
ctctcttttcttctttctga

SEQ ID NO: 9372 - DNA, 20 bp, Artificial Sequence
  Description of Artificial Sequence: Synthetic oligonucleotide
  Target: SOD1; (+) strand; PAM type: NRG; PAM sequence: AGG
tctcttttcttctttctgac

SEQ ID NO: 9373 - DNA, 20 bp, Artificial Sequence
  Description of Artificial Sequence: Synthetic oligonucleotide
  Target: SOD1; (+) strand; PAM type: NRG; PAM sequence: GGG
ctcttttcttctttctgaca

SEQ ID NO: 9374 - DNA, 20 bp, Artificial Sequence
  Description of Artificial Sequence: Synthetic oligonucleotide
  Target: SOD1; (+) strand; PAM type: NRG; PAM sequence: TGG
tgttctgcttctttaaaccc

SEQ ID NO: 9375 - DNA, 20 bp, Artificial Sequence
  Description of Artificial Sequence: Synthetic oligonucleotide
  Target: SOD1; (+) strand; PAM type: NRG; PAM sequence: GGG
gttctgcttctttaaaccct

SEQ ID NO: 9376 - DNA, 20 bp, Artificial Sequence
  Description of Artificial Sequence: Synthetic oligonucleotide
  Target: SOD1; (+) strand; PAM type: NRG; PAM sequence: GGG
ttctgcttctttaaaccctg

SEQ ID NO: 9377 - DNA, 20 bp, Artificial Sequence
  Description of Artificial Sequence: Synthetic oligonucleotide
  Target: SOD1; (+) strand; PAM type: NRG; PAM sequence: AAG
ttctttaaaccctggggttc

SEQ ID NO: 9378 - DNA, 20 bp, Artificial Sequence
  Description of Artificial Sequence: Synthetic oligonucleotide
  Target: SOD1; (+) strand; PAM type: NRG; PAM sequence: AAG
aaccctggggttcaagtgca

SEQ ID NO: 9379 - DNA, 20 bp, Artificial Sequence
  Description of Artificial Sequence: Synthetic oligonucleotide
  Target: SOD1; (+) strand; PAM type: NRG; PAM sequence: AGG
accctggggttcaagtgcaa

SEQ ID NO: 9380 - DNA, 20 bp, Artificial Sequence
  Description of Artificial Sequence: Synthetic oligonucleotide
  Target: SOD1; (+) strand; PAM type: NRG; PAM sequence: AAG
ttccctattttattttattt

SEQ ID NO: 9381 - DNA, 20 bp, Artificial Sequence
  Description of Artificial Sequence: Synthetic oligonucleotide
  Target: SOD1; (+) strand; PAM type: NRG; PAM sequence: TAG
ctattttattttatttaagt

SEQ ID NO: 9382 - DNA, 20 bp, Artificial Sequence
  Description of Artificial Sequence: Synthetic oligonucleotide
  Target: SOD1; (+) strand; PAM type: NRG; PAM sequence: GAG
tgatgatgatgattattgtt

SEQ ID NO: 9383 - DNA, 20 bp, Artificial Sequence
  Description of Artificial Sequence: Synthetic oligonucleotide
  Target: SOD1; (+) strand; PAM type: NRG; PAM sequence: CAG
gatgatgattattgttgaga

SEQ ID NO: 9384 - DNA, 20 bp, Artificial Sequence
  Description of Artificial Sequence: Synthetic oligonucleotide
  Target: SOD1; (+) strand; PAM type: NRG; PAM sequence: AGG
atgatgattattgttgagac

SEQ ID NO: 9385 - DNA, 20 bp, Artificial Sequence
  Description of Artificial Sequence: Synthetic oligonucleotide
  Target: SOD1; (+) strand; PAM type: NRG; PAM sequence: CAG
caggatttcattctgttgcc

SEQ ID NO: 9386 - DNA, 20 bp, Artificial Sequence
  Description of Artificial Sequence: Synthetic oligonucleotide
  Target: SOD1; (+) strand; PAM type: NRG; PAM sequence: AGG
aggatttcattctgttgccc

SEQ ID NO: 9387 - DNA, 20 bp, Artificial Sequence
  Description of Artificial Sequence: Synthetic oligonucleotide
  Target: SOD1; (+) strand; PAM type: NRG; PAM sequence: TGG
tttcattctgttgcccaggc

SEQ ID NO: 9388 - DNA, 20 bp, Artificial Sequence
  Description of Artificial Sequence: Synthetic oligonucleotide
  Target: SOD1; (+) strand; PAM type: NRG; PAM sequence: GAG
tcattctgttgcccaggctg

SEQ ID NO: 9389 - DNA, 20 bp, Artificial Sequence
  Description of Artificial Sequence: Synthetic oligonucleotide
  Target: SOD1; (+) strand; PAM type: NRG; PAM sequence: TGG
ttgcccaggctggagtgcaa

SEQ ID NO: 9390 - DNA, 20 bp, Artificial Sequence
  Description of Artificial Sequence: Synthetic oligonucleotide
  Target: SOD1; (+) strand; PAM type: NRG; PAM sequence: CAG
ggtgcgatcacaactcactg

SEQ ID NO: 9391 - DNA, 20 bp, Artificial Sequence
  Description of Artificial Sequence: Synthetic oligonucleotide
  Target: SOD1; (+) strand; PAM type: NRG; PAM sequence: TGG
tcactgcagcctcaacctcc

SEQ ID NO: 9392 - DNA, 20 bp, Artificial Sequence
  Description of Artificial Sequence: Synthetic oligonucleotide
  Target: SOD1; (+) strand; PAM type: NRG; PAM sequence: GGG
cactgcagcctcaacctcct

SEQ ID NO: 9393 - DNA, 20 bp, Artificial Sequence
  Description of Artificial Sequence: Synthetic oligonucleotide
  Target: SOD1; (+) strand; PAM type: NRG; PAM sequence: CAG
cccacgcgatcctcctacct

SEQ ID NO: 9394 - DNA, 20 bp, Artificial Sequence
  Description of Artificial Sequence: Synthetic oligonucleotide
  Target: SOD1; (+) strand; PAM type: NRG; PAM sequence: AAG
tcctcctacctcagcctccc

SEQ ID NO: 9395 - DNA, 20 bp, Artificial Sequence
  Description of Artificial Sequence: Synthetic oligonucleotide
  Target: SOD1; (+) strand; PAM type: NRG; PAM sequence: TAG
tcctacctcagcctcccaag

SEQ ID NO: 9396 - DNA, 20 bp, Artificial Sequence
  Description of Artificial Sequence: Synthetic oligonucleotide
  Target: SOD1; (+) strand; PAM type: NRG; PAM sequence: TGG
cctcagcctcccaagtagct

SEQ ID NO: 9397 - DNA, 20 bp, Artificial Sequence
  Description of Artificial Sequence: Synthetic oligonucleotide
  Target: SOD1; (+) strand; PAM type: NRG; PAM sequence: CAG
ctcccaagtagcttggacta

SEQ ID NO: 9398 - DNA, 20 bp, Artificial Sequence
  Description of Artificial Sequence: Synthetic oligonucleotide
  Target: SOD1; (+) strand; PAM type: NRG; PAM sequence: AGG
tcccaagtagcttggactac

SEQ ID NO: 9399 - DNA, 20 bp, Artificial Sequence
  Description of Artificial Sequence: Synthetic oligonucleotide
  Target: SOD1; (+) strand; PAM type: NRG; PAM sequence: GGG
cccaagtagcttggactaca

SEQ ID NO: 9400 - DNA, 20 bp, Artificial Sequence
  Description of Artificial Sequence: Synthetic oligonucleotide
  Target: SOD1; (+) strand; PAM type: NRG; PAM sequence: GGG
ccaagtagcttggactacag

SEQ ID NO: 9401 - DNA, 20 bp, Artificial Sequence
  Description of Artificial Sequence: Synthetic oligonucleotide
  Target: SOD1; (+) strand; PAM type: NRG; PAM sequence: CGG
caggggtgtaccaccatgcc

SEQ ID NO: 9402 - DNA, 20 bp, Artificial Sequence
  Description of Artificial Sequence: Synthetic oligonucleotide
  Target: SOD1; (+) strand; PAM type: NRG; PAM sequence: CAG
gcccggctaattacatgtgc

SEQ ID NO: 9403 - DNA, 20 bp, Artificial Sequence
  Description of Artificial Sequence: Synthetic oligonucleotide
  Target: SOD1; (+) strand; PAM type: NRG; PAM sequence: CAG
gccagattcaacccacgttc

SEQ ID NO: 9404 - DNA, 20 bp, Artificial Sequence
  Description of Artificial Sequence: Synthetic oligonucleotide
  Target: SOD1; (+) strand; PAM type: NRG; PAM sequence: AGG
ccagattcaacccacgttcc

SEQ ID NO: 9405 - DNA, 20 bp, Artificial Sequence
  Description of Artificial Sequence: Synthetic oligonucleotide
  Target: SOD1; (+) strand; PAM type: NRG; PAM sequence: GGG
cagattcaacccacgttcca

SEQ ID NO: 9406 - DNA, 20 bp, Artificial Sequence
  Description of Artificial Sequence: Synthetic oligonucleotide
  Target: SOD1; (+) strand; PAM type: NRG; PAM sequence: AAG
ttccagggttccaaacaacc

SEQ ID NO: 9407 - DNA, 20 bp, Artificial Sequence
  Description of Artificial Sequence: Synthetic oligonucleotide
  Target: SOD1; (+) strand; PAM type: NRG; PAM sequence: AGG
tccagggttccaaacaacca

SEQ ID NO: 9408 - DNA, 20 bp, Artificial Sequence
  Description of Artificial Sequence: Synthetic oligonucleotide
  Target: SOD1; (+) strand; PAM type: NRG; PAM sequence: AAG
ttaacaaatataccttcata

SEQ ID NO: 9409 - DNA, 20 bp, Artificial Sequence
  Description of Artificial Sequence: Synthetic oligonucleotide
  Target: SOD1; (+) strand; PAM type: NRG; PAM sequence: TGG
aatataccttcataaagacc

SEQ ID NO: 9410 - DNA, 20 bp, Artificial Sequence
  Description of Artificial Sequence: Synthetic oligonucleotide
  Target: SOD1; (+) strand; PAM type: NRG; PAM sequence: AAG
ataccttcataaagacctgg

SEQ ID NO: 9411 - DNA, 20 bp, Artificial Sequence
  Description of Artificial Sequence: Synthetic oligonucleotide
  Target: SOD1; (+) strand; PAM type: NRG; PAM sequence: AGG
taccttcataaagacctgga

SEQ ID NO: 9412 - DNA, 20 bp, Artificial Sequence
  Description of Artificial Sequence: Synthetic oligonucleotide
  Target: SOD1; (+) strand; PAM type: NRG; PAM sequence: CAG
cttcataaagacctggaagg

SEQ ID NO: 9413 - DNA, 20 bp, Artificial Sequence
  Description of Artificial Sequence: Synthetic oligonucleotide
  Target: SOD1; (+) strand; PAM type: NRG; PAM sequence: AGG
ttcataaagacctggaaggc

SEQ ID NO: 9414 - DNA, 20 bp, Artificial Sequence
  Description of Artificial Sequence: Synthetic oligonucleotide
  Target: SOD1; (+) strand; PAM type: NRG; PAM sequence: TGG
ctggaaggcaggttgaaatg

SEQ ID NO: 9415 - DNA, 20 bp, Artificial Sequence
  Description of Artificial Sequence: Synthetic oligonucleotide
  Target: SOD1; (+) strand; PAM type: NRG; PAM sequence: TGG
aggttgaaatgtggaattct

SEQ ID NO: 9416 - DNA, 20 bp, Artificial Sequence
  Description of Artificial Sequence: Synthetic oligonucleotide
  Target: SOD1; (+) strand; PAM type: NRG; PAM sequence: CAG
tggaattcttggacttcttt

SEQ ID NO: 9417 - DNA, 20 bp, Artificial Sequence
  Description of Artificial Sequence: Synthetic oligonucleotide
  Target: SOD1; (+) strand; PAM type: NRG; PAM sequence: TAG
ggacttctttcagttctacg

SEQ ID NO: 9418 - DNA, 20 bp, Artificial Sequence
  Description of Artificial Sequence: Synthetic oligonucleotide
  Target: SOD1; (+) strand; PAM type: NRG; PAM sequence: AAG
cttctttcagttctacgtag

SEQ ID NO: 9419 - DNA, 20 bp, Artificial Sequence
  Description of Artificial Sequence: Synthetic oligonucleotide
  Target: SOD1; (+) strand; PAM type: NRG; PAM sequence: AGG
ttctttcagttctacgtaga

SEQ ID NO: 9420 - DNA, 20 bp, Artificial Sequence
  Description of Artificial Sequence: Synthetic oligonucleotide
  Target: SOD1; (+) strand; PAM type: NRG; PAM sequence: GGG
tctttcagttctacgtagaa

SEQ ID NO: 9421 - DNA, 20 bp, Artificial Sequence
  Description of Artificial Sequence: Synthetic oligonucleotide
  Target: SOD1; (+) strand; PAM type: NRG; PAM sequence: TAG
ttcagttctacgtagaaggg

SEQ ID NO: 9422 - DNA, 20 bp, Artificial Sequence
  Description of Artificial Sequence: Synthetic oligonucleotide
  Target: SOD1; (+) strand; PAM type: NRG; PAM sequence: CAG
agttctacgtagaagggtag

SEQ ID NO: 9423 - DNA, 20 bp, Artificial Sequence
  Description of Artificial Sequence: Synthetic oligonucleotide
  Target: SOD1; (+) strand; PAM type: NRG; PAM sequence: TGG
tctacgtagaagggtagcag

SEQ ID NO: 9424 - DNA, 20 bp, Artificial Sequence
  Description of Artificial Sequence: Synthetic oligonucleotide
  Target: SOD1; (+) strand; PAM type: NRG; PAM sequence: GAG
tacgtagaagggtagcagtg

SEQ ID NO: 9425 - DNA, 20 bp, Artificial Sequence
  Description of Artificial Sequence: Synthetic oligonucleotide
  Target: SOD1; (+) strand; PAM type: NRG; PAM sequence: GAG
cgtagaagggtagcagtgga

SEQ ID NO: 9426 - DNA, 20 bp, Artificial Sequence
  Description of Artificial Sequence: Synthetic oligonucleotide
  Target: SOD1; (+) strand; PAM type: NRG; PAM sequence: TGG
gaagggtagcagtggagagc

SEQ ID NO: 9427 - DNA, 20 bp, Artificial Sequence
  Description of Artificial Sequence: Synthetic oligonucleotide
  Target: SOD1; (+) strand; PAM type: NRG; PAM sequence: TGG
gctggctgcctgcccgcccc

SEQ ID NO: 9428 - DNA, 20 bp, Artificial Sequence
  Description of Artificial Sequence: Synthetic oligonucleotide
  Target: SOD1; (+) strand; PAM type: NRG; PAM sequence: TGG
ttccccacccctgctccttg

SEQ ID NO: 9429 - DNA, 20 bp, Artificial Sequence
  Description of Artificial Sequence: Synthetic oligonucleotide
  Target: SOD1; (+) strand; PAM type: NRG; PAM sequence: TGG
acccctgctccttgtggcac

SEQ ID NO: 9430 - DNA, 20 bp, Artificial Sequence
  Description of Artificial Sequence: Synthetic oligonucleotide
  Target: SOD1; (+) strand; PAM type: NRG; PAM sequence: GGG
cccctgctccttgtggcact

SEQ ID NO: 9431 - DNA, 20 bp, Artificial Sequence
  Description of Artificial Sequence: Synthetic oligonucleotide
  Target: SOD1; (+) strand; PAM type: NRG; PAM sequence: CAG
ctgctccttgtggcactggg

SEQ ID NO: 9432 - DNA, 20 bp, Artificial Sequence
  Description of Artificial Sequence: Synthetic oligonucleotide
  Target: SOD1; (+) strand; PAM type: NRG; PAM sequence: AGG
tgctccttgtggcactgggc

SEQ ID NO: 9433 - DNA, 20 bp, Artificial Sequence
  Description of Artificial Sequence: Synthetic oligonucleotide
  Target: SOD1; (+) strand; PAM type: NRG; PAM sequence: GGG
gctccttgtggcactgggca

SEQ ID NO: 9434 - DNA, 20 bp, Artificial Sequence
  Description of Artificial Sequence: Synthetic oligonucleotide
  Target: SOD1; (+) strand; PAM type: NRG; PAM sequence: AAG
actgggcagggcctacgttc

SEQ ID NO: 9435 - DNA, 20 bp, Artificial Sequence
  Description of Artificial Sequence: Synthetic oligonucleotide
  Target: SOD1; (+) strand; PAM type: NRG; PAM sequence: AGG
ctgggcagggcctacgttca

SEQ ID NO: 9436 - DNA, 20 bp, Artificial Sequence
  Description of Artificial Sequence: Synthetic oligonucleotide
  Target: SOD1; (+) strand; PAM type: NRG; PAM sequence: TAG
gcagggcctacgttcaaggc

SEQ ID NO: 9437 - DNA, 20 bp, Artificial Sequence
  Description of Artificial Sequence: Synthetic oligonucleotide
  Target: SOD1; (+) strand; PAM type: NRG; PAM sequence: CAG
gggcctacgttcaaggctag

SEQ ID NO: 9438 - DNA, 20 bp, Artificial Sequence
  Description of Artificial Sequence: Synthetic oligonucleotide
  Target: SOD1; (+) strand; PAM type: NRG; PAM sequence: AAG
aggctagcagtgtactcaac

SEQ ID NO: 9439 - DNA, 20 bp, Artificial Sequence
  Description of Artificial Sequence: Synthetic oligonucleotide
  Target: SOD1; (+) strand; PAM type: NRG; PAM sequence: AGG
ggctagcagtgtactcaaca

SEQ ID NO: 9440 - DNA, 20 bp, Artificial Sequence
  Description of Artificial Sequence: Synthetic oligonucleotide
  Target: SOD1; (+) strand; PAM type: NRG; PAM sequence: GGG
gctagcagtgtactcaacaa

SEQ ID NO: 9441 - DNA, 20 bp, Artificial Sequence
  Description of Artificial Sequence: Synthetic oligonucleotide
  Target: SOD1; (+) strand; PAM type: NRG; PAM sequence: CAG
gcagtgtactcaacaaggga

SEQ ID NO: 9442 - DNA, 20 bp, Artificial Sequence
  Description of Artificial Sequence: Synthetic oligonucleotide
  Target: SOD1; (+) strand; PAM type: NRG; PAM sequence: TGG
aacaagggacagtccctgtg

SEQ ID NO: 9443 - DNA, 20 bp, Artificial Sequence
  Description of Artificial Sequence: Synthetic oligonucleotide
  Target: SOD1; (+) strand; PAM type: NRG; PAM sequence: CAG
cagtccctgtgtggcctgtt

SEQ ID NO: 9444 - DNA, 20 bp, Artificial Sequence
  Description of Artificial Sequence: Synthetic oligonucleotide
  Target: SOD1; (+) strand; PAM type: NRG; PAM sequence: AGG
agtccctgtgtggcctgttc

SEQ ID NO: 9445 - DNA, 20 bp, Artificial Sequence
  Description of Artificial Sequence: Synthetic oligonucleotide
  Target: SOD1; (+) strand; PAM type: NRG; PAM sequence: CAG
cctgttcaggatcctataca

SEQ ID NO: 9446 - DNA, 20 bp, Artificial Sequence
  Description of Artificial Sequence: Synthetic oligonucleotide
  Target: SOD1; (+) strand; PAM type: NRG; PAM sequence: AGG
ctgttcaggatcctatacac

SEQ ID NO: 9447 - DNA, 20 bp, Artificial Sequence
  Description of Artificial Sequence: Synthetic oligonucleotide
  Target: SOD1; (+) strand; PAM type: NRG; PAM sequence: CAG
caggatcctatacacaggct

SEQ ID NO: 9448 - DNA, 20 bp, Artificial Sequence
  Description of Artificial Sequence: Synthetic oligonucleotide
  Target: SOD1; (+) strand; PAM type: NRG; PAM sequence: AGG
aggatcctatacacaggctc

SEQ ID NO: 9449 - DNA, 20 bp, Artificial Sequence
  Description of Artificial Sequence: Synthetic oligonucleotide
  Target: SOD1; (+) strand; PAM type: NRG; PAM sequence: GGG
ggatcctatacacaggctca

SEQ ID NO: 9450 - DNA, 20 bp, Artificial Sequence
  Description of Artificial Sequence: Synthetic oligonucleotide
  Target: SOD1; (+) strand; PAM type: NRG; PAM sequence: TGG
tacacaggctcagggctctt

SEQ ID NO: 9451 - DNA, 20 bp, Artificial Sequence
  Description of Artificial Sequence: Synthetic oligonucleotide
  Target: SOD1; (+) strand; PAM type: NRG; PAM sequence: GGG
acacaggctcagggctcttt

SEQ ID NO: 9452 - DNA, 20 bp, Artificial Sequence
  Description of Artificial Sequence: Synthetic oligonucleotide
  Target: SOD1; (+) strand; PAM type: NRG; PAM sequence: CAG
caggctcagggctctttggg

SEQ ID NO: 9453 - DNA, 20 bp, Artificial Sequence
  Description of Artificial Sequence: Synthetic oligonucleotide
  Target: SOD1; (+) strand; PAM type: NRG; PAM sequence: AGG
aggctcagggctctttgggc

SEQ ID NO: 9454 - DNA, 20 bp, Artificial Sequence
  Description of Artificial Sequence: Synthetic oligonucleotide
  Target: SOD1; (+) strand; PAM type: NRG; PAM sequence: CAG
gctctttgggcaggaaattc

SEQ ID NO: 9455 - DNA, 20 bp, Artificial Sequence
  Description of Artificial Sequence: Synthetic oligonucleotide
  Target: SOD1; (+) strand; PAM type: NRG; PAM sequence: AGG
ctctttgggcaggaaattcc

SEQ ID NO: 9456 - DNA, 20 bp, Artificial Sequence
  Description of Artificial Sequence: Synthetic oligonucleotide
  Target: SOD1; (+) strand; PAM type: NRG; PAM sequence: CGG
gggcaggaaattccaggatc

SEQ ID NO: 9457 - DNA, 20 bp, Artificial Sequence
  Description of Artificial Sequence: Synthetic oligonucleotide
  Target: SOD1; (+) strand; PAM type: NRG; PAM sequence: GGG
ggcaggaaattccaggatcc

SEQ ID NO: 9458 - DNA, 20 bp, Artificial Sequence
  Description of Artificial Sequence: Synthetic oligonucleotide
  Target: SOD1; (+) strand; PAM type: NRG; PAM sequence: AAG
attccaggatccgggtactc

SEQ ID NO: 9459 - DNA, 20 bp, Artificial Sequence
  Description of Artificial Sequence: Synthetic oligonucleotide
  Target: SOD1; (+) strand; PAM type: NRG; PAM sequence: TGG
ccaggatccgggtactcaag

SEQ ID NO: 9460 - DNA, 20 bp, Artificial Sequence
  Description of Artificial Sequence: Synthetic oligonucleotide
  Target: SOD1; (+) strand; PAM type: NRG; PAM sequence: CAG
tactcaagtggtgttctaaa

SEQ ID NO: 9461 - DNA, 20 bp, Artificial Sequence
  Description of Artificial Sequence: Synthetic oligonucleotide
  Target: SOD1; (+) strand; PAM type: NRG; PAM sequence: TGG
tcaagtggtgttctaaacag

SEQ ID NO: 9462 - DNA, 20 bp, Artificial Sequence
  Description of Artificial Sequence: Synthetic oligonucleotide
  Target: SOD1; (+) strand; PAM type: NRG; PAM sequence: TGG
gtgttctaaacagtggttct

SEQ ID NO: 9463 - DNA, 20 bp, Artificial Sequence
  Description of Artificial Sequence: Synthetic oligonucleotide
  Target: SOD1; (+) strand; PAM type: NRG; PAM sequence: CGG
tctaaacagtggttcttggc

SEQ ID NO: 9464 - DNA, 20 bp, Artificial Sequence
  Description of Artificial Sequence: Synthetic oligonucleotide
  Target: SOD1; (+) strand; PAM type: NRG; PAM sequence: GGG
ctaaacagtggttcttggcc

SEQ ID NO: 9465 - DNA, 20 bp, Artificial Sequence
  Description of Artificial Sequence: Synthetic oligonucleotide
  Target: SOD1; (+) strand; PAM type: NRG; PAM sequence: TGG
cagtggttcttggccgggtg

SEQ ID NO: 9466 - DNA, 20 bp, Artificial Sequence
  Description of Artificial Sequence: Synthetic oligonucleotide
  Target: SOD1; (+) strand; PAM type: NRG; PAM sequence: TGG
tggttcttggccgggtgtgg

SEQ ID NO: 9467 - DNA, 20 bp, Artificial Sequence
  Description of Artificial Sequence: Synthetic oligonucleotide
  Target: SOD1; (+) strand; PAM type: NRG; PAM sequence: CAG
gtggctcacacctgtaatcc

SEQ ID NO: 9468 - DNA, 20 bp, Artificial Sequence
  Description of Artificial Sequence: Synthetic oligonucleotide
  Target: SOD1; (+) strand; PAM type: NRG; PAM sequence: TGG
cacctgtaatcccagcactt

SEQ ID NO: 9469 - DNA, 20 bp, Artificial Sequence
  Description of Artificial Sequence: Synthetic oligonucleotide
  Target: SOD1; (+) strand; PAM type: NRG; PAM sequence: GGG
acctgtaatcccagcacttt

SEQ ID NO: 9470 - DNA, 20 bp, Artificial Sequence
  Description of Artificial Sequence: Synthetic oligonucleotide
  Target: SOD1; (+) strand; PAM type: NRG; PAM sequence: GAG
ctgtaatcccagcactttgg

SEQ ID NO: 9471 - DNA, 20 bp, Artificial Sequence
  Description of Artificial Sequence: Synthetic oligonucleotide
  Target: SOD1; (+) strand; PAM type: NRG; PAM sequence: AGG
tgtaatcccagcactttggg

SEQ ID NO: 9472 - DNA, 20 bp, Artificial Sequence
  Description of Artificial Sequence: Synthetic oligonucleotide
  Target: SOD1; (+) strand; PAM type: NRG; PAM sequence: GAG
tcccagcactttgggaggcc

SEQ ID NO: 9473 - DNA, 20 bp, Artificial Sequence
  Description of Artificial Sequence: Synthetic oligonucleotide
  Target: SOD1; (+) strand; PAM type: NRG; PAM sequence: AGG
cccagcactttgggaggccg

SEQ ID NO: 9474 - DNA, 20 bp, Artificial Sequence
  Description of Artificial Sequence: Synthetic oligonucleotide
  Target: SOD1; (+) strand; PAM type: NRG; PAM sequence: TGG
gcactttgggaggccgaggc

SEQ ID NO: 9475 - DNA, 20 bp, Artificial Sequence
  Description of Artificial Sequence: Synthetic oligonucleotide
  Target: SOD1; (+) strand; PAM type: NRG; PAM sequence: CAG
ctttgggaggccgaggctgg

SEQ ID NO: 9476 - DNA, 20 bp, Artificial Sequence
  Description of Artificial Sequence: Synthetic oligonucleotide
  Target: SOD1; (+) strand; PAM type: NRG; PAM sequence: GAG
ccgaggctggcagatcactt

SEQ ID NO: 9477 - DNA, 20 bp, Artificial Sequence
  Description of Artificial Sequence: Synthetic oligonucleotide
  Target: SOD1; (+) strand; PAM type: NRG; PAM sequence: AGG
cgaggctggcagatcacttg

SEQ ID NO: 9478 - DNA, 20 bp, Artificial Sequence
  Description of Artificial Sequence: Synthetic oligonucleotide
  Target: SOD1; (+) strand; PAM type: NRG; PAM sequence: CAG
gctggcagatcacttgaggt

SEQ ID NO: 9479 - DNA, 20 bp, Artificial Sequence
  Description of Artificial Sequence: Synthetic oligonucleotide
  Target: SOD1; (+) strand; PAM type: NRG; PAM sequence: AGG
ctggcagatcacttgaggtc

SEQ ID NO: 9480 - DNA, 20 bp, Artificial Sequence
  Description of Artificial Sequence: Synthetic oligonucleotide
  Target: SOD1; (+) strand; PAM type: NRG; PAM sequence: GAG
ggcagatcacttgaggtcag

SEQ ID NO: 9481 - DNA, 20 bp, Artificial Sequence
  Description of Artificial Sequence: Synthetic oligonucleotide
  Target: SOD1; (+) strand; PAM type: NRG; PAM sequence: GAG
tcacttgaggtcaggagttc

SEQ ID NO: 9482 - DNA, 20 bp, Artificial Sequence
  Description of Artificial Sequence: Synthetic oligonucleotide
  Target: SOD1; (+) strand; PAM type: NRG; PAM sequence: CAG
tgaggtcaggagttcgagac

SEQ ID NO: 9483 - DNA, 20 bp, Artificial Sequence
  Description of Artificial Sequence: Synthetic oligonucleotide
  Target: SOD1; (+) strand; PAM type: NRG; PAM sequence: TGG
tcaggagttcgagaccagcc

SEQ ID NO: 9484 - DNA, 20 bp, Artificial Sequence
  Description of Artificial Sequence: Synthetic oligonucleotide
  Target: SOD1; (+) strand; PAM type: NRG; PAM sequence: TGG
cgagaccagcctggccaaca

SEQ ID NO: 9485 - DNA, 20 bp, Artificial Sequence
  Description of Artificial Sequence: Synthetic oligonucleotide
  Target: SOD1; (+) strand; PAM type: NRG; PAM sequence: TAG
ctactaaaaatacaaaaact

SEQ ID NO: 9486 - DNA, 20 bp, Artificial Sequence
  Description of Artificial Sequence: Synthetic oligonucleotide
  Target: SOD1; (+) strand; PAM type: NRG; PAM sequence: CAG
taaaaatacaaaaacttagc

SEQ ID NO: 9487 - DNA, 20 bp, Artificial Sequence
  Description of Artificial Sequence: Synthetic oligonucleotide
  Target: SOD1; (+) strand; PAM type: NRG; PAM sequence: AGG
aaaaatacaaaaacttagcc

SEQ ID NO: 9488 - DNA, 20 bp, Artificial Sequence
  Description of Artificial Sequence: Synthetic oligonucleotide
  Target: SOD1; (+) strand; PAM type: NRG; PAM sequence: TGG
tacaaaaacttagccaggca

SEQ ID NO: 9489 - DNA, 20 bp, Artificial Sequence
  Description of Artificial Sequence: Synthetic oligonucleotide
  Target: SOD1; (+) strand; PAM type: NRG; PAM sequence: TAG
aggcatggtgtgcacgcctg

SEQ ID NO: 9490 - DNA, 20 bp, Artificial Sequence
  Description of Artificial Sequence: Synthetic oligonucleotide
  Target: SOD1; (+) strand; PAM type: NRG; PAM sequence: CAG
ggtgtgcacgcctgtagtcc

SEQ ID NO: 9491 - DNA, 20 bp, Artificial Sequence
  Description of Artificial Sequence: Synthetic oligonucleotide
  Target: SOD1; (+) strand; PAM type: NRG; PAM sequence: CGG
cgcctgtagtcccagctact

SEQ ID NO: 9492 - DNA, 20 bp, Artificial Sequence
  Description of Artificial Sequence: Synthetic oligonucleotide
  Target: SOD1; (+) strand; PAM type: NRG; PAM sequence: GGG
gcctgtagtcccagctactc

SEQ ID NO: 9493 - DNA, 20 bp, Artificial Sequence
  Description of Artificial Sequence: Synthetic oligonucleotide
  Target: SOD1; (+) strand; PAM type: NRG; PAM sequence: GAG
ctgtagtcccagctactcgg

SEQ ID NO: 9494 - DNA, 20 bp, Artificial Sequence
  Description of Artificial Sequence: Synthetic oligonucleotide
  Target: SOD1; (+) strand; PAM type: NRG; PAM sequence: AGG
tgtagtcccagctactcggg

SEQ ID NO: 9495 - DNA, 20 bp, Artificial Sequence
  Description of Artificial Sequence: Synthetic oligonucleotide
  Target: SOD1; (+) strand; PAM type: NRG; PAM sequence: GAG
tcccagctactcgggaggct

SEQ ID NO: 9496 - DNA, 20 bp, Artificial Sequence
  Description of Artificial Sequence: Synthetic oligonucleotide
  Target: SOD1; (+) strand; PAM type: NRG; PAM sequence: AGG
cccagctactcgggaggctg

SEQ ID NO: 9497 - DNA, 20 bp, Artificial Sequence
  Description of Artificial Sequence: Synthetic oligonucleotide
  Target: SOD1; (+) strand; PAM type: NRG; PAM sequence: CAG
agctactcgggaggctgagg

SEQ ID NO: 9498 - DNA, 20 bp, Artificial Sequence
  Description of Artificial Sequence: Synthetic oligonucleotide
  Target: SOD1; (+) strand; PAM type: NRG; PAM sequence: AGG
gctactcgggaggctgaggc

SEQ ID NO: 9499 - DNA, 20 bp, Artificial Sequence
  Description of Artificial Sequence: Synthetic oligonucleotide
  Target: SOD1; (+) strand; PAM type: NRG; PAM sequence: GAG
tactcgggaggctgaggcag

SEQ ID NO: 9500 - DNA, 20 bp, Artificial Sequence
  Description of Artificial Sequence: Synthetic oligonucleotide
  Target: SOD1; (+) strand; PAM type: NRG; PAM sequence: CAG
gcaggagaatcacttgaacc

SEQ ID NO: 9501 - DNA, 20 bp, Artificial Sequence
  Description of Artificial Sequence: Synthetic oligonucleotide
  Target: SOD1; (+) strand; PAM type: NRG; PAM sequence: CAG
ggagaatcacttgaacccag

SEQ ID NO: 9502 - DNA, 20 bp, Artificial Sequence
  Description of Artificial Sequence: Synthetic oligonucleotide
  Target: SOD1; (+) strand; PAM type: NRG; PAM sequence: AGG
gagaatcacttgaacccagc

SEQ ID NO: 9503 - DNA, 20 bp, Artificial Sequence
  Description of Artificial Sequence: Synthetic oligonucleotide
  Target: SOD1; (+) strand; PAM type: NRG; PAM sequence: CGG
aatcacttgaacccagcagg

SEQ ID NO: 9504 - DNA, 20 bp, Artificial Sequence
  Description of Artificial Sequence: Synthetic oligonucleotide
  Target: SOD1; (+) strand; PAM type: NRG; PAM sequence: GAG
tcacttgaacccagcaggcg

SEQ ID NO: 9505 - DNA, 20 bp, Artificial Sequence
  Description of Artificial Sequence: Synthetic oligonucleotide
  Target: SOD1; (+) strand; PAM type: NRG; PAM sequence: AGG
cacttgaacccagcaggcgg

SEQ ID NO: 9506 - DNA, 20 bp, Artificial Sequence
  Description of Artificial Sequence: Synthetic oligonucleotide
  Target: SOD1; (+) strand; PAM type: NRG; PAM sequence: CAG
aacccagcaggcggaggttg

SEQ ID NO: 9507 - DNA, 20 bp, Artificial Sequence
  Description of Artificial Sequence: Synthetic oligonucleotide
  Target: SOD1; (+) strand; PAM type: NRG; PAM sequence: GAG
cagcaggcggaggttgcagt

SEQ ID NO: 9508 - DNA, 20 bp, Artificial Sequence
  Description of Artificial Sequence: Synthetic oligonucleotide
  Target: SOD1; (+) strand; PAM type: NRG; PAM sequence: GAG
ggcggaggttgcagtgagct

SEQ ID NO: 9509 - DNA, 20 bp, Artificial Sequence
  Description of Artificial Sequence: Synthetic oligonucleotide
  Target: SOD1; (+) strand; PAM type: NRG; PAM sequence: CAG
gagattgcaccactgcactc

SEQ ID NO: 9510 - DNA, 20 bp, Artificial Sequence
  Description of Artificial Sequence: Synthetic oligonucleotide
  Target: SOD1; (+) strand; PAM type: NRG; PAM sequence: TGG
tgcaccactgcactccagcc

SEQ ID NO: 9511 - DNA, 20 bp, Artificial Sequence
  Description of Artificial Sequence: Synthetic oligonucleotide
  Target: SOD1; (+) strand; PAM type: NRG; PAM sequence: CAG
actgcactccagcctggtga

SEQ ID NO: 9512 - DNA, 20 bp, Artificial Sequence
  Description of Artificial Sequence: Synthetic oligonucleotide
  Target: SOD1; (+) strand; PAM type: NRG; PAM sequence: GAG
tgcactccagcctggtgaca

SEQ ID NO: 9513 - DNA, 20 bp, Artificial Sequence
  Description of Artificial Sequence: Synthetic oligonucleotide
  Target: SOD1; (+) strand; PAM type: NRG; PAM sequence: GAG
ctccagcctggtgacagagt

SEQ ID NO: 9514 - DNA, 20 bp, Artificial Sequence
  Description of Artificial Sequence: Synthetic oligonucleotide
  Target: SOD1; (+) strand; PAM type: NRG; PAM sequence: CAG
aatacataaataaataaaaa

SEQ ID NO: 9515 - DNA, 20 bp, Artificial Sequence
  Description of Artificial Sequence: Synthetic oligonucleotide
  Target: SOD1; (+) strand; PAM type: NRG; PAM sequence: TGG
taaaaacagtgattcttaac

SEQ ID NO: 9516 - DNA, 20 bp, Artificial Sequence
  Description of Artificial Sequence: Synthetic oligonucleotide
  Target: SOD1; (+) strand; PAM type: NRG; PAM sequence: GGG
aaaaacagtgattcttaact

SEQ ID NO: 9517 - DNA, 20 bp, Artificial Sequence
  Description of Artificial Sequence: Synthetic oligonucleotide
  Target: SOD1; (+) strand; PAM type: NRG; PAM sequence: GAG
aaacagtgattcttaactgg

SEQ ID NO: 9518 - DNA, 20 bp, Artificial Sequence
  Description of Artificial Sequence: Synthetic oligonucleotide
  Target: SOD1; (+) strand; PAM type: NRG; PAM sequence: TGG
attcttaactgggagtgatt

SEQ ID NO: 9519 - DNA, 20 bp, Artificial Sequence
  Description of Artificial Sequence: Synthetic oligonucleotide
  Target: SOD1; (+) strand; PAM type: NRG; PAM sequence: TGG
gggagtgatttggcaacgtc

SEQ ID NO: 9520 - DNA, 20 bp, Artificial Sequence
  Description of Artificial Sequence: Synthetic oligonucleotide
  Target: SOD1; (+) strand; PAM type: NRG; PAM sequence: TGG
gcaacgtctggaattatttt

SEQ ID NO: 9521 - DNA, 20 bp, Artificial Sequence
  Description of Artificial Sequence: Synthetic oligonucleotide
  Target: SOD1; (+) strand; PAM type: NRG; PAM sequence: CAG
ggaattatttttggttatcc

SEQ ID NO: 9522 - DNA, 20 bp, Artificial Sequence
  Description of Artificial Sequence: Synthetic oligonucleotide
  Target: SOD1; (+) strand; PAM type: NRG; PAM sequence: TGG
tatttttggttatcccagcc

SEQ ID NO: 9523 - DNA, 20 bp, Artificial Sequence
  Description of Artificial Sequence: Synthetic oligonucleotide
  Target: SOD1; (+) strand; PAM type: NRG; PAM sequence: CAG
ttttggttatcccagcctgg

SEQ ID NO: 9524 - DNA, 20 bp, Artificial Sequence
  Description of Artificial Sequence: Synthetic oligonucleotide
  Target: SOD1; (+) strand; PAM type: NRG; PAM sequence: AGG
tttggttatcccagcctggc

SEQ ID NO: 9525 - DNA, 20 bp, Artificial Sequence
  Description of Artificial Sequence: Synthetic oligonucleotide
  Target: SOD1; (+) strand; PAM type: NRG; PAM sequence: GGG
ttggttatcccagcctggca

SEQ ID NO: 9526 - DNA, 20 bp, Artificial Sequence
  Description of Artificial Sequence: Synthetic oligonucleotide
  Target: SOD1; (+) strand; PAM type: NRG; PAM sequence: GAG
ggttatcccagcctggcagg

SEQ ID NO: 9527 - DNA, 20 bp, Artificial Sequence
  Description of Artificial Sequence: Synthetic oligonucleotide
  Target: SOD1; (+) strand; PAM type: NRG; PAM sequence: AGG
gttatcccagcctggcaggg

SEQ ID NO: 9528 - DNA, 20 bp, Artificial Sequence
  Description of Artificial Sequence: Synthetic oligonucleotide
  Target: SOD1; (+) strand; PAM type: NRG; PAM sequence: GGG
ttatcccagcctggcaggga

SEQ ID NO: 9529 - DNA, 20 bp, Artificial Sequence
  Description of Artificial Sequence: Synthetic oligonucleotide
  Target: SOD1; (+) strand; PAM type: NRG; PAM sequence: CAG
cccagcctggcagggaggga

SEQ ID NO: 9530 - DNA, 20 bp, Artificial Sequence
  Description of Artificial Sequence: Synthetic oligonucleotide
  Target: SOD1; (+) strand; PAM type: NRG; PAM sequence: AGG
ccagcctggcagggagggac

SEQ ID NO: 9531 - DNA, 20 bp, Artificial Sequence
  Description of Artificial Sequence: Synthetic oligonucleotide
  Target: SOD1; (+) strand; PAM type: NRG; PAM sequence: GGG
cagcctggcagggagggaca

SEQ ID NO: 9532 - DNA, 20 bp, Artificial Sequence
  Description of Artificial Sequence: Synthetic oligonucleotide
  Target: SOD1; (+) strand; PAM type: NRG; PAM sequence: TGG
agggagggacagggtattac

SEQ ID NO: 9533 - DNA, 20 bp, Artificial Sequence
  Description of Artificial Sequence: Synthetic oligonucleotide
  Target: SOD1; (+) strand; PAM type: NRG; PAM sequence: TAG
gacagggtattactggcatc

SEQ ID NO: 9534 - DNA, 20 bp, Artificial Sequence
  Description of Artificial Sequence: Synthetic oligonucleotide
  Target: SOD1; (+) strand; PAM type: NRG; PAM sequence: GAG
gggtattactggcatctagt

SEQ ID NO: 9535 - DNA, 20 bp, Artificial Sequence
  Description of Artificial Sequence: Synthetic oligonucleotide
  Target: SOD1; (+) strand; PAM type: NRG; PAM sequence: TAG
tattactggcatctagtgag

SEQ ID NO: 9536 - DNA, 20 bp, Artificial Sequence
  Description of Artificial Sequence: Synthetic oligonucleotide
  Target: SOD1; (+) strand; PAM type: NRG; PAM sequence: AGG
attactggcatctagtgagt

SEQ ID NO: 9537 - DNA, 20 bp, Artificial Sequence
  Description of Artificial Sequence: Synthetic oligonucleotide
  Target: SOD1; (+) strand; PAM type: NRG; PAM sequence: GGG
ttactggcatctagtgagta

SEQ ID NO: 9538 - DNA, 20 bp, Artificial Sequence
  Description of Artificial Sequence: Synthetic oligonucleotide
  Target: SOD1; (+) strand; PAM type: NRG; PAM sequence: GGG
tactggcatctagtgagtag

SEQ ID NO: 9539 - DNA, 20 bp, Artificial Sequence
  Description of Artificial Sequence: Synthetic oligonucleotide
  Target: SOD1; (+) strand; PAM type: NRG; PAM sequence: TAG
ggcatctagtgagtaggggc

SEQ ID NO: 9540 - DNA, 20 bp, Artificial Sequence
  Description of Artificial Sequence: Synthetic oligonucleotide
  Target: SOD1; (+) strand; PAM type: NRG; PAM sequence: AGG
gcatctagtgagtaggggct

SEQ ID NO: 9541 - DNA, 20 bp, Artificial Sequence
  Description of Artificial Sequence: Synthetic oligonucleotide
  Target: SOD1; (+) strand; PAM type: NRG; PAM sequence: GGG
catctagtgagtaggggcta

SEQ ID NO: 9542 - DNA, 20 bp, Artificial Sequence
  Description of Artificial Sequence: Synthetic oligonucleotide
  Target: SOD1; (+) strand; PAM type: NRG; PAM sequence: CAG
ggattctactgaacatccta

SEQ ID NO: 9543 - DNA, 20 bp, Artificial Sequence
  Description of Artificial Sequence: Synthetic oligonucleotide
  Target: SOD1; (+) strand; PAM type: NRG; PAM sequence: CAG
actgaacatcctacagtgta

SEQ ID NO: 9544 - DNA, 20 bp, Artificial Sequence
  Description of Artificial Sequence: Synthetic oligonucleotide
  Target: SOD1; (+) strand; PAM type: NRG; PAM sequence: AGG
ctgaacatcctacagtgtac

SEQ ID NO: 9545 - DNA, 20 bp, Artificial Sequence
  Description of Artificial Sequence: Synthetic oligonucleotide
  Target: SOD1; (+) strand; PAM type: NRG; PAM sequence: CAG
acatcctacagtgtacagga

SEQ ID NO: 9546 - DNA, 20 bp, Artificial Sequence
  Description of Artificial Sequence: Synthetic oligonucleotide
  Target: SOD1; (+) strand; PAM type: NRG; PAM sequence: CAG
agtgtacaggacagcctcca

SEQ ID NO: 9547 - DNA, 20 bp, Artificial Sequence
  Description of Artificial Sequence: Synthetic oligonucleotide
  Target: SOD1; (+) strand; PAM type: NRG; PAM sequence: AAG
acaggacagcctccacagca

SEQ ID NO: 9548 - DNA, 20 bp, Artificial Sequence
  Description of Artificial Sequence: Synthetic oligonucleotide
  Target: SOD1; (+) strand; PAM type: NRG; PAM sequence: TGG
ctccacagcaaagaactgtc

SEQ ID NO: 9549 - DNA, 20 bp, Artificial Sequence
  Description of Artificial Sequence: Synthetic oligonucleotide
  Target: SOD1; (+) strand; PAM type: NRG; PAM sequence: TAG
tgtctggcccaaaatgtcca

SEQ ID NO: 9550 - DNA, 20 bp, Artificial Sequence
  Description of Artificial Sequence: Synthetic oligonucleotide
  Target: SOD1; (+) strand; PAM type: NRG; PAM sequence: TAG
ccacattcgatgccctgcat

SEQ ID NO: 9551 - DNA, 20 bp, Artificial Sequence
  Description of Artificial Sequence: Synthetic oligonucleotide
  Target: SOD1; (+) strand; PAM type: NRG; PAM sequence: AGG
cacattcgatgccctgcatt

SEQ ID NO: 9552 - DNA, 20 bp, Artificial Sequence
  Description of Artificial Sequence: Synthetic oligonucleotide
  Target: SOD1; (+) strand; PAM type: NRG; PAM sequence: AAG
attcgatgccctgcattagg

SEQ ID NO: 9553 - DNA, 20 bp, Artificial Sequence
  Description of Artificial Sequence: Synthetic oligonucleotide
  Target: SOD1; (+) strand; PAM type: NRG; PAM sequence: CAG
ataaatactcttaaatatca

SEQ ID NO: 9554 - DNA, 20 bp, Artificial Sequence
  Description of Artificial Sequence: Synthetic oligonucleotide
  Target: SOD1; (+) strand; PAM type: NRG; PAM sequence: GAG
aaatactcttaaatatcaca

SEQ ID NO: 9555 - DNA, 20 bp, Artificial Sequence
  Description of Artificial Sequence: Synthetic oligonucleotide
  Target: SOD1; (+) strand; PAM type: NRG; PAM sequence: TAG
taaattccttacccctgttc

SEQ ID NO: 9556 - DNA, 20 bp, Artificial Sequence
  Description of Artificial Sequence: Synthetic oligonucleotide
  Target: SOD1; (+) strand; PAM type: NRG; PAM sequence: CAG
attccttacccctgttctag

SEQ ID NO: 9557 - DNA, 20 bp, Artificial Sequence
  Description of Artificial Sequence: Synthetic oligonucleotide
  Target: SOD1; (+) strand; PAM type: NRG; PAM sequence: GAG
tccttacccctgttctagca

SEQ ID NO: 9558 - DNA, 20 bp, Artificial Sequence
  Description of Artificial Sequence: Synthetic oligonucleotide
  Target: SOD1; (+) strand; PAM type: NRG; PAM sequence: CGG
tagcagagatgatattcttg

SEQ ID NO: 9559 - DNA, 20 bp, Artificial Sequence
  Description of Artificial Sequence: Synthetic oligonucleotide
  Target: SOD1; (+) strand; PAM type: NRG; PAM sequence: GGG
agcagagatgatattcttgc

SEQ ID NO: 9560 - DNA, 20 bp, Artificial Sequence
  Description of Artificial Sequence: Synthetic oligonucleotide
  Target: SOD1; (+) strand; PAM type: NRG; PAM sequence: GGG
gcagagatgatattcttgcg

SEQ ID NO: 9561 - DNA, 20 bp, Artificial Sequence
  Description of Artificial Sequence: Synthetic oligonucleotide
  Target: SOD1; (+) strand; PAM type: NRG; PAM sequence: GGG
cagagatgatattcttgcgg

SEQ ID NO: 9562 - DNA, 20 bp, Artificial Sequence
  Description of Artificial Sequence: Synthetic oligonucleotide
  Target: SOD1; (+) strand; PAM type: NRG; PAM sequence: GGG
agagatgatattcttgcggg

SEQ ID NO: 9563 - DNA, 20 bp, Artificial Sequence
  Description of Artificial Sequence: Synthetic oligonucleotide
  Target: SOD1; (+) strand; PAM type: NRG; PAM sequence: GAG
agatgatattcttgcggggg

SEQ ID NO: 9564 - DNA, 20 bp, Artificial Sequence
  Description of Artificial Sequence: Synthetic oligonucleotide
  Target: SOD1; (+) strand; PAM type: NRG; PAM sequence: TGG
ttgcggggggagcatcttct

SEQ ID NO: 9565 - DNA, 20 bp, Artificial Sequence
  Description of Artificial Sequence: Synthetic oligonucleotide
  Target: SOD1; (+) strand; PAM type: NRG; PAM sequence: TGG
tcaacacattcttttctcca

SEQ ID NO: 9566 - DNA, 20 bp, Artificial Sequence
  Description of Artificial Sequence: Synthetic oligonucleotide
  Target: SOD1; (+) strand; PAM type: NRG; PAM sequence: GGG
caacacattcttttctccat

SEQ ID NO: 9567 - DNA, 20 bp, Artificial Sequence
  Description of Artificial Sequence: Synthetic oligonucleotide
  Target: SOD1; (+) strand; PAM type: NRG; PAM sequence: GAG
acacattcttttctccatgg

SEQ ID NO: 9568 - DNA, 20 bp, Artificial Sequence
  Description of Artificial Sequence: Synthetic oligonucleotide
  Target: SOD1; (+) strand; PAM type: NRG; PAM sequence: CAG
ttctccatgggagatgatgc

SEQ ID NO: 9569 - DNA, 20 bp, Artificial Sequence
  Description of Artificial Sequence: Synthetic oligonucleotide
  Target: SOD1; (+) strand; PAM type: NRG; PAM sequence: AAG
tccatgggagatgatgccag

SEQ ID NO: 9570 - DNA, 20 bp, Artificial Sequence
  Description of Artificial Sequence: Synthetic oligonucleotide
  Target: SOD1; (+) strand; PAM type: NRG; PAM sequence: GAG
catgggagatgatgccagaa

SEQ ID NO: 9571 - DNA, 20 bp, Artificial Sequence
  Description of Artificial Sequence: Synthetic oligonucleotide
  Target: SOD1; (+) strand; PAM type: NRG; PAM sequence: AGG
atgggagatgatgccagaag

SEQ ID NO: 9572 - DNA, 20 bp, Artificial Sequence
  Description of Artificial Sequence: Synthetic oligonucleotide
  Target: SOD1; (+) strand; PAM type: NRG; PAM sequence: GGG
tgggagatgatgccagaaga

SEQ ID NO: 9573 - DNA, 20 bp, Artificial Sequence
  Description of Artificial Sequence: Synthetic oligonucleotide
  Target: SOD1; (+) strand; PAM type: NRG; PAM sequence: CAG
agatgatgccagaagaggga

SEQ ID NO: 9574 - DNA, 20 bp, Artificial Sequence
  Description of Artificial Sequence: Synthetic oligonucleotide
  Target: SOD1; (+) strand; PAM type: NRG; PAM sequence: CAG
atgccagaagagggacagaa

SEQ ID NO: 9575 - DNA, 20 bp, Artificial Sequence
  Description of Artificial Sequence: Synthetic oligonucleotide
  Target: SOD1; (+) strand; PAM type: NRG; PAM sequence: AGG
tgccagaagagggacagaac

SEQ ID NO: 9576 - DNA, 20 bp, Artificial Sequence
  Description of Artificial Sequence: Synthetic oligonucleotide
  Target: SOD1; (+) strand; PAM type: NRG; PAM sequence: GGG
gccagaagagggacagaaca

SEQ ID NO: 9577 - DNA, 20 bp, Artificial Sequence
  Description of Artificial Sequence: Synthetic oligonucleotide
  Target: SOD1; (+) strand; PAM type: NRG; PAM sequence: CAG
aagagggacagaacagggcc

SEQ ID NO: 9578 - DNA, 20 bp, Artificial Sequence
  Description of Artificial Sequence: Synthetic oligonucleotide
  Target: SOD1; (+) strand; PAM type: NRG; PAM sequence: AAG
ggacagaacagggcccagta

SEQ ID NO: 9579 - DNA, 20 bp, Artificial Sequence
  Description of Artificial Sequence: Synthetic oligonucleotide
  Target: SOD1; (+) strand; PAM type: NRG; PAM sequence: TGG
gaacagggcccagtaaagca

SEQ ID NO: 9580 - DNA, 20 bp, Artificial Sequence
  Description of Artificial Sequence: Synthetic oligonucleotide
  Target: SOD1; (+) strand; PAM type: NRG; PAM sequence: GGG
aacagggcccagtaaagcat

SEQ ID NO: 9581 - DNA, 20 bp, Artificial Sequence
  Description of Artificial Sequence: Synthetic oligonucleotide
  Target: SOD1; (+) strand; PAM type: NRG; PAM sequence: GGG
acagggcccagtaaagcatg

SEQ ID NO: 9582 - DNA, 20 bp, Artificial Sequence
  Description of Artificial Sequence: Synthetic oligonucleotide
  Target: SOD1; (+) strand; PAM type: NRG; PAM sequence: TGG
gcccagtaaagcatggggcc

SEQ ID NO: 9583 - DNA, 20 bp, Artificial Sequence
  Description of Artificial Sequence: Synthetic oligonucleotide
  Target: SOD1; (+) strand; PAM type: NRG; PAM sequence: GGG
cccagtaaagcatggggcct

SEQ ID NO: 9584 - DNA, 20 bp, Artificial Sequence
  Description of Artificial Sequence: Synthetic oligonucleotide
  Target: SOD1; (+) strand; PAM type: NRG; PAM sequence: GGG
ccagtaaagcatggggcctg

SEQ ID NO: 9585 - DNA, 20 bp, Artificial Sequence
  Description of Artificial Sequence: Synthetic oligonucleotide
  Target: SOD1; (+) strand; PAM type: NRG; PAM sequence: CAG
taaagcatggggcctggggc

SEQ ID NO: 9586 - DNA, 20 bp, Artificial Sequence
  Description of Artificial Sequence: Synthetic oligonucleotide
  Target: SOD1; (+) strand; PAM type: NRG; PAM sequence: AGG
aaagcatggggcctggggcc

SEQ ID NO: 9587 - DNA, 20 bp, Artificial Sequence
  Description of Artificial Sequence: Synthetic oligonucleotide
  Target: SOD1; (+) strand; PAM type: NRG; PAM sequence: GGG
aagcatggggcctggggcca

SEQ ID NO: 9588 - DNA, 20 bp, Artificial Sequence
  Description of Artificial Sequence: Synthetic oligonucleotide
  Target: SOD1; (+) strand; PAM type: NRG; PAM sequence: CAG
gggccagggacccccttgtt

SEQ ID NO: 9589 - DNA, 20 bp, Artificial Sequence
  Description of Artificial Sequence: Synthetic oligonucleotide
  Target: SOD1; (+) strand; PAM type: NRG; PAM sequence: AGG
ggccagggacccccttgttc

SEQ ID NO: 9590 - DNA, 20 bp, Artificial Sequence
  Description of Artificial Sequence: Synthetic oligonucleotide
  Target: SOD1; (+) strand; PAM type: NRG; PAM sequence: AAG
ggtgtgacgaccatcctacg

SEQ ID NO: 9591 - DNA, 20 bp, Artificial Sequence
  Description of Artificial Sequence: Synthetic oligonucleotide
  Target: SOD1; (+) strand; PAM type: NRG; PAM sequence: AGG
gtgtgacgaccatcctacga

SEQ ID NO: 9592 - DNA, 20 bp, Artificial Sequence
  Description of Artificial Sequence: Synthetic oligonucleotide
  Target: SOD1; (+) strand; PAM type: NRG; PAM sequence: CAG
catcctacgaaggcaccacc

SEQ ID NO: 9593 - DNA, 20 bp, Artificial Sequence
  Description of Artificial Sequence: Synthetic oligonucleotide
  Target: SOD1; (+) strand; PAM type: NRG; PAM sequence: AGG
atcctacgaaggcaccaccc

SEQ ID NO: 9594 - DNA, 20 bp, Artificial Sequence
  Description of Artificial Sequence: Synthetic oligonucleotide
  Target: SOD1; (+) strand; PAM type: NRG; PAM sequence: TAG
aggcaccacccaggcatcat

SEQ ID NO: 9595 - DNA, 20 bp, Artificial Sequence
  Description of Artificial Sequence: Synthetic oligonucleotide
  Target: SOD1; (+) strand; PAM type: NRG; PAM sequence: AAG
gcatcattagaccgtctcaa

SEQ ID NO: 9596 - DNA, 20 bp, Artificial Sequence
  Description of Artificial Sequence: Synthetic oligonucleotide
  Target: SOD1; (+) strand; PAM type: NRG; PAM sequence: AAG
tcattagaccgtctcaaaag

SEQ ID NO: 9597 - DNA, 20 bp, Artificial Sequence
  Description of Artificial Sequence: Synthetic oligonucleotide
  Target: SOD1; (+) strand; PAM type: NRG; PAM sequence: GAG
attagaccgtctcaaaagaa

SEQ ID NO: 9598 - DNA, 20 bp, Artificial Sequence
  Description of Artificial Sequence: Synthetic oligonucleotide
  Target: SOD1; (+) strand; PAM type: NRG; PAM sequence: AAG
aagagtaattcactgtccca

SEQ ID NO: 9599 - DNA, 20 bp, Artificial Sequence
  Description of Artificial Sequence: Synthetic oligonucleotide
  Target: SOD1; (+) strand; PAM type: NRG; PAM sequence: CAG
agtaattcactgtcccaaag

SEQ ID NO: 9600 - DNA, 20 bp, Artificial Sequence
  Description of Artificial Sequence: Synthetic oligonucleotide
  Target: SOD1; (+) strand; PAM type: NRG; PAM sequence: TGG
aagcagctctctcgtgtctg

SEQ ID NO: 9601 - DNA, 20 bp, Artificial Sequence
  Description of Artificial Sequence: Synthetic oligonucleotide
  Target: SOD1; (+) strand; PAM type: NRG; PAM sequence: GGG
agcagctctctcgtgtctgt

SEQ ID NO: 9602 - DNA, 20 bp, Artificial Sequence
  Description of Artificial Sequence: Synthetic oligonucleotide
  Target: SOD1; (+) strand; PAM type: NRG; PAM sequence: CGG
agctctctcgtgtctgtggg

SEQ ID NO: 9603 - DNA, 20 bp, Artificial Sequence
  Description of Artificial Sequence: Synthetic oligonucleotide
  Target: SOD1; (+) strand; PAM type: NRG; PAM sequence: TGG
gtgtctgtgggcggatccct

SEQ ID NO: 9604 - DNA, 20 bp, Artificial Sequence
  Description of Artificial Sequence: Synthetic oligonucleotide
  Target: SOD1; (+) strand; PAM type: NRG; PAM sequence: AAG
ctgtgggcggatcccttggc

SEQ ID NO: 9605 - DNA, 20 bp, Artificial Sequence
  Description of Artificial Sequence: Synthetic oligonucleotide
  Target: SOD1; (+) strand; PAM type: NRG; PAM sequence: TGG
ctgaaatctgccgaacttcc

SEQ ID NO: 9606 - DNA, 20 bp, Artificial Sequence
  Description of Artificial Sequence: Synthetic oligonucleotide
  Target: SOD1; (+) strand; PAM type: NRG; PAM sequence: AAG
gccgaacttcctggaaccca

SEQ ID NO: 9607 - DNA, 20 bp, Artificial Sequence
  Description of Artificial Sequence: Synthetic oligonucleotide
  Target: SOD1; (+) strand; PAM type: NRG; PAM sequence: TAG
cctggaacccaaagaaactt

SEQ ID NO: 9608 - DNA, 20 bp, Artificial Sequence
  Description of Artificial Sequence: Synthetic oligonucleotide
  Target: SOD1; (+) strand; PAM type: NRG; PAM sequence: TGG
acccaaagaaactttagcct

SEQ ID NO: 9609 - DNA, 20 bp, Artificial Sequence
  Description of Artificial Sequence: Synthetic oligonucleotide
  Target: SOD1; (+) strand; PAM type: NRG; PAM sequence: GGG
cccaaagaaactttagcctt

SEQ ID NO: 9610 - DNA, 20 bp, Artificial Sequence
  Description of Artificial Sequence: Synthetic oligonucleotide
  Target: SOD1; (+) strand; PAM type: NRG; PAM sequence: AAG
agaaactttagccttgggca

SEQ ID NO: 9611 - DNA, 20 bp, Artificial Sequence
  Description of Artificial Sequence: Synthetic oligonucleotide
  Target: SOD1; (+) strand; PAM type: NRG; PAM sequence: AGG
gaaactttagccttgggcaa

SEQ ID NO: 9612 - DNA, 20 bp, Artificial Sequence
  Description of Artificial Sequence: Synthetic oligonucleotide
  Target: SOD1; (+) strand; PAM type: NRG; PAM sequence: TGG
agccttgggcaaaggccctt

SEQ ID NO: 9613 - DNA, 20 bp, Artificial Sequence
  Description of Artificial Sequence: Synthetic oligonucleotide
  Target: SOD1; (+) strand; PAM type: NRG; PAM sequence: CAG
ttgggcaaaggccctttggc

SEQ ID NO: 9614 - DNA, 20 bp, Artificial Sequence
  Description of Artificial Sequence: Synthetic oligonucleotide
  Target: SOD1; (+) strand; PAM type: NRG; PAM sequence: TAG
gcactgtttatgcaaccgtt

SEQ ID NO: 9615 - DNA, 20 bp, Artificial Sequence
  Description of Artificial Sequence: Synthetic oligonucleotide
  Target: SOD1; (+) strand; PAM type: NRG; PAM sequence: TGG
tttagaatatacgaattatc

SEQ ID NO: 9616 - DNA, 20 bp, Artificial Sequence
  Description of Artificial Sequence: Synthetic oligonucleotide
  Target: SOD1; (+) strand; PAM type: NRG; PAM sequence: GAG
tagaatatacgaattatctg

SEQ ID NO: 9617 - DNA, 20 bp, Artificial Sequence
  Description of Artificial Sequence: Synthetic oligonucleotide
  Target: SOD1; (+) strand; PAM type: NRG; PAM sequence: CAG
gagactactaccaaatacaa

SEQ ID NO: 9618 - DNA, 20 bp, Artificial Sequence
  Description of Artificial Sequence: Synthetic oligonucleotide
  Target: SOD1; (+) strand; PAM type: NRG; PAM sequence: AGG
agactactaccaaatacaac

SEQ ID NO: 9619 - DNA, 20 bp, Artificial Sequence
  Description of Artificial Sequence: Synthetic oligonucleotide
  Target: SOD1; (+) strand; PAM type: NRG; PAM sequence: TAG
ctgcaaatatgtatacttcc

SEQ ID NO: 9620 - DNA, 20 bp, Artificial Sequence
  Description of Artificial Sequence: Synthetic oligonucleotide
  Target: SOD1; (+) strand; PAM type: NRG; PAM sequence: GAG
gcaaatatgtatacttccta

SEQ ID NO: 9621 - DNA, 20 bp, Artificial Sequence
  Description of Artificial Sequence: Synthetic oligonucleotide
  Target: SOD1; (+) strand; PAM type: NRG; PAM sequence: AGG
caaatatgtatacttcctag

SEQ ID NO: 9622 - DNA, 20 bp, Artificial Sequence
  Description of Artificial Sequence: Synthetic oligonucleotide
  Target: SOD1; (+) strand; PAM type: NRG; PAM sequence: TAG
tgtgaattgtatttctctga

SEQ ID NO: 9623 - DNA, 20 bp, Artificial Sequence
  Description of Artificial Sequence: Synthetic oligonucleotide
  Target: SOD1; (+) strand; PAM type: NRG; PAM sequence: GAG
tgaattgtatttctctgata

SEQ ID NO: 9624 - DNA, 20 bp, Artificial Sequence
  Description of Artificial Sequence: Synthetic oligonucleotide
  Target: SOD1; (+) strand; PAM type: NRG; PAM sequence: AGG
gaattgtatttctctgatag

SEQ ID NO: 9625 - DNA, 20 bp, Artificial Sequence
  Description of Artificial Sequence: Synthetic oligonucleotide
  Target: SOD1; (+) strand; PAM type: NRG; PAM sequence: TAG
ttctctgatagaggatgcat

SEQ ID NO: 9626 - DNA, 20 bp, Artificial Sequence
  Description of Artificial Sequence: Synthetic oligonucleotide
  Target: SOD1; (+) strand; PAM type: NRG; PAM sequence: GAG
ctctgatagaggatgcatta

SEQ ID NO: 9627 - DNA, 20 bp, Artificial Sequence
  Description of Artificial Sequence: Synthetic oligonucleotide
  Target: SOD1; (+) strand; PAM type: NRG; PAM sequence: GAG
tagaggatgcattagagtct

SEQ ID NO: 9628 - DNA, 20 bp, Artificial Sequence
  Description of Artificial Sequence: Synthetic oligonucleotide
  Target: SOD1; (+) strand; PAM type: NRG; PAM sequence: AGG
agaggatgcattagagtctg

SEQ ID NO: 9629 - DNA, 20 bp, Artificial Sequence
  Description of Artificial Sequence: Synthetic oligonucleotide
  Target: SOD1; (+) strand; PAM type: NRG; PAM sequence: GGG
gaggatgcattagagtctga

SEQ ID NO: 9630 - DNA, 20 bp, Artificial Sequence
  Description of Artificial Sequence: Synthetic oligonucleotide
  Target: SOD1; (+) strand; PAM type: NRG; PAM sequence: TAG
ttagagtctgagggtctaaa

SEQ ID NO: 9631 - DNA, 20 bp, Artificial Sequence
  Description of Artificial Sequence: Synthetic oligonucleotide
  Target: SOD1; (+) strand; PAM type: NRG; PAM sequence: AAG
aaatagcgtaaataataaat

SEQ ID NO: 9632 - DNA, 20 bp, Artificial Sequence
  Description of Artificial Sequence: Synthetic oligonucleotide
  Target: SOD1; (+) strand; PAM type: NRG; PAM sequence: TAG
taaataagtaaataaatcga

SEQ ID NO: 9633 - DNA, 20 bp, Artificial Sequence
  Description of Artificial Sequence: Synthetic oligonucleotide
  Target: SOD1; (+) strand; PAM type: NRG; PAM sequence: TAG
ataagtaaataaatcgatag

SEQ ID NO: 9634 - DNA, 20 bp, Artificial Sequence
  Description of Artificial Sequence: Synthetic oligonucleotide
  Target: SOD1; (+) strand; PAM type: NRG; PAM sequence: GAG
gatagtagtgtactccaaac

SEQ ID NO: 9635 - DNA, 20 bp, Artificial Sequence
  Description of Artificial Sequence: Synthetic oligonucleotide
  Target: SOD1; (+) strand; PAM type: NRG; PAM sequence: AGG
atagtagtgtactccaaacg

SEQ ID NO: 9636 - DNA, 20 bp, Artificial Sequence
  Description of Artificial Sequence: Synthetic oligonucleotide
  Target: SOD1; (+) strand; PAM type: NRG; PAM sequence: TGG
tagtgtactccaaacgaggc

SEQ ID NO: 9637 - DNA, 20 bp, Artificial Sequence
  Description of Artificial Sequence: Synthetic oligonucleotide
  Target: SOD1; (+) strand; PAM type: NRG; PAM sequence: TAG
tactccaaacgaggctggaa

SEQ ID NO: 9638 - DNA, 20 bp, Artificial Sequence
  Description of Artificial Sequence: Synthetic oligonucleotide
  Target: SOD1; (+) strand; PAM type: NRG; PAM sequence: TGG
cttctattgttgtttcacac

SEQ ID NO: 9639 - DNA, 20 bp, Artificial Sequence
  Description of Artificial Sequence: Synthetic oligonucleotide
  Target: SOD1; (+) strand; PAM type: NRG; PAM sequence: AAG
tttcacactggacttcaatt

SEQ ID NO: 9640 - DNA, 20 bp, Artificial Sequence
  Description of Artificial Sequence: Synthetic oligonucleotide
  Target: SOD1; (+) strand; PAM type: NRG; PAM sequence: CAG
actggacttcaattaagtct

SEQ ID NO: 9641 - DNA, 20 bp, Artificial Sequence
  Description of Artificial Sequence: Synthetic oligonucleotide
  Target: SOD1; (+) strand; PAM type: NRG; PAM sequence: AAG
attttgccatactcaatatt

SEQ ID NO: 9642 - DNA, 20 bp, Artificial Sequence
  Description of Artificial Sequence: Synthetic oligonucleotide
  Target: SOD1; (+) strand; PAM type: NRG; PAM sequence: TAG
ccatactcaatattaagtac

SEQ ID NO: 9643 - DNA, 20 bp, Artificial Sequence
  Description of Artificial Sequence: Synthetic oligonucleotide
  Target: SOD1; (+) strand; PAM type: NRG; PAM sequence: AGG
catactcaatattaagtact

SEQ ID NO: 9644 - DNA, 20 bp, Artificial Sequence
  Description of Artificial Sequence: Synthetic oligonucleotide
  Target: SOD1; (+) strand; PAM type: NRG; PAM sequence: TGG
ctcaatattaagtactaggc

SEQ ID NO: 9645 - DNA, 20 bp, Artificial Sequence
  Description of Artificial Sequence: Synthetic oligonucleotide
  Target: SOD1; (+) strand; PAM type: NRG; PAM sequence: TGG
attaagtactaggctggacg

SEQ ID NO: 9646 - DNA, 20 bp, Artificial Sequence
  Description of Artificial Sequence: Synthetic oligonucleotide
  Target: SOD1; (+) strand; PAM type: NRG; PAM sequence: TGG
aagtactaggctggacgtgg

SEQ ID NO: 9647 - DNA, 20 bp, Artificial Sequence
  Description of Artificial Sequence: Synthetic oligonucleotide
  Target: SOD1; (+) strand; PAM type: NRG; PAM sequence: CAG
gtggctcatgtctgtaatcc

SEQ ID NO: 9648 - DNA, 20 bp, Artificial Sequence
  Description of Artificial Sequence: Synthetic oligonucleotide
  Target: SOD1; (+) strand; PAM type: NRG; PAM sequence: TGG
tgtctgtaatcccagcactt

SEQ ID NO: 9649 - DNA, 20 bp, Artificial Sequence
  Description of Artificial Sequence: Synthetic oligonucleotide
  Target: SOD1; (+) strand; PAM type: NRG; PAM sequence: GGG
gtctgtaatcccagcacttt

SEQ ID NO: 9650 - DNA, 20 bp, Artificial Sequence
  Description of Artificial Sequence: Synthetic oligonucleotide
  Target: SOD1; (+) strand; PAM type: NRG; PAM sequence: GAG
ctgtaatcccagcactttgg

SEQ ID NO: 9651 - DNA, 20 bp, Artificial Sequence
  Description of Artificial Sequence: Synthetic oligonucleotide
  Target: SOD1; (+) strand; PAM type: NRG; PAM sequence: AGG
tgtaatcccagcactttggg

SEQ ID NO: 9652 - DNA, 20 bp, Artificial Sequence
  Description of Artificial Sequence: Synthetic oligonucleotide
  Target: SOD1; (+) strand; PAM type: NRG; PAM sequence: GAG
tcccagcactttgggaggcc

SEQ ID NO: 9653 - DNA, 20 bp, Artificial Sequence
  Description of Artificial Sequence: Synthetic oligonucleotide
  Target: SOD1; (+) strand; PAM type: NRG; PAM sequence: AGG
cccagcactttgggaggccg

SEQ ID NO: 9654 - DNA, 20 bp, Artificial Sequence
  Description of Artificial Sequence: Synthetic oligonucleotide
  Target: SOD1; (+) strand; PAM type: NRG; PAM sequence: TGG
agcactttgggaggccgagg

SEQ ID NO: 9655 - DNA, 20 bp, Artificial Sequence
  Description of Artificial Sequence: Synthetic oligonucleotide
  Target: SOD1; (+) strand; PAM type: NRG; PAM sequence: GGG
gcactttgggaggccgaggt

SEQ ID NO: 9656 - DNA, 20 bp, Artificial Sequence
  Description of Artificial Sequence: Synthetic oligonucleotide
  Target: SOD1; (+) strand; PAM type: NRG; PAM sequence: TAG
ctttgggaggccgaggtggg

SEQ ID NO: 9657 - DNA, 20 bp, Artificial Sequence
  Description of Artificial Sequence: Synthetic oligonucleotide
  Target: SOD1; (+) strand; PAM type: NRG; PAM sequence: TGG
gggaggccgaggtgggtaga

SEQ ID NO: 9658 - DNA, 20 bp, Artificial Sequence
  Description of Artificial Sequence: Synthetic oligonucleotide
  Target: SOD1; (+) strand; PAM type: NRG; PAM sequence: TGG
ggccgaggtgggtagatggc

SEQ ID NO: 9659 - DNA, 20 bp, Artificial Sequence
  Description of Artificial Sequence: Synthetic oligonucleotide
  Target: SOD1; (+) strand; PAM type: NRG; PAM sequence: GAG
ggtgggtagatggctggctt

SEQ ID NO: 9660 - DNA, 20 bp, Artificial Sequence
  Description of Artificial Sequence: Synthetic oligonucleotide
  Target: SOD1; (+) strand; PAM type: NRG; PAM sequence: CAG
gtagatggctggcttgagct

SEQ ID NO: 9661 - DNA, 20 bp, Artificial Sequence
  Description of Artificial Sequence: Synthetic oligonucleotide
  Target: SOD1; (+) strand; PAM type: NRG; PAM sequence: AGG
tagatggctggcttgagctc

SEQ ID NO: 9662 - DNA, 20 bp, Artificial Sequence
  Description of Artificial Sequence: Synthetic oligonucleotide
  Target: SOD1; (+) strand; PAM type: NRG; PAM sequence: GAG
gatggctggcttgagctcag

SEQ ID NO: 9663 - DNA, 20 bp, Artificial Sequence
  Description of Artificial Sequence: Synthetic oligonucleotide
  Target: SOD1; (+) strand; PAM type: NRG; PAM sequence: CAG
tgagctcaggagtttgaaac

SEQ ID NO: 9664 - DNA, 20 bp, Artificial Sequence
  Description of Artificial Sequence: Synthetic oligonucleotide
  Target: SOD1; (+) strand; PAM type: NRG; PAM sequence: TGG
tcaggagtttgaaaccagcc

SEQ ID NO: 9665 - DNA, 20 bp, Artificial Sequence
  Description of Artificial Sequence: Synthetic oligonucleotide
  Target: SOD1; (+) strand; PAM type: NRG; PAM sequence: GGG
caggagtttgaaaccagcct

SEQ ID NO: 9666 - DNA, 20 bp, Artificial Sequence
  Description of Artificial Sequence: Synthetic oligonucleotide
  Target: SOD1; (+) strand; PAM type: NRG; PAM sequence: TGG
tgaaaccagcctgggcaaca

SEQ ID NO: 9667 - DNA, 20 bp, Artificial Sequence
  Description of Artificial Sequence: Synthetic oligonucleotide
  Target: SOD1; (+) strand; PAM type: NRG; PAM sequence: CAG
tgtacccaaaatacaaaaat

SEQ ID NO: 9668 - DNA, 20 bp, Artificial Sequence
  Description of Artificial Sequence: Synthetic oligonucleotide
  Target: SOD1; (+) strand; PAM type: NRG; PAM sequence: CAG
cccaaaatacaaaaatcagc

SEQ ID NO: 9669 - DNA, 20 bp, Artificial Sequence
  Description of Artificial Sequence: Synthetic oligonucleotide
  Target: SOD1; (+) strand; PAM type: NRG; PAM sequence: AGG
ccaaaatacaaaaatcagcc

SEQ ID NO: 9670 - DNA, 20 bp, Artificial Sequence
  Description of Artificial Sequence: Synthetic oligonucleotide
  Target: SOD1; (+) strand; PAM type: NRG; PAM sequence: TGG
atacaaaaatcagccaggtg

SEQ ID NO: 9671 - DNA, 20 bp, Artificial Sequence
  Description of Artificial Sequence: Synthetic oligonucleotide
  Target: SOD1; (+) strand; PAM type: NRG; PAM sequence: TGG
caaaaatcagccaggtgtgg

SEQ ID NO: 9672 - DNA, 20 bp, Artificial Sequence
  Description of Artificial Sequence: Synthetic oligonucleotide
  Target: SOD1; (+) strand; PAM type: NRG; PAM sequence: TGG
ggtgtggtggcacatgcctg

SEQ ID NO: 9673 - DNA, 20 bp, Artificial Sequence
  Description of Artificial Sequence: Synthetic oligonucleotide
  Target: SOD1; (+) strand; PAM type: NRG; PAM sequence: CAG
gtggcacatgcctgtggtcc

SEQ ID NO: 9674 - DNA, 20 bp, Artificial Sequence
  Description of Artificial Sequence: Synthetic oligonucleotide
  Target: SOD1; (+) strand; PAM type: NRG; PAM sequence: AGG
tggcacatgcctgtggtccc

SEQ ID NO: 9675 - DNA, 20 bp, Artificial Sequence
  Description of Artificial Sequence: Synthetic oligonucleotide
  Target: SOD1; (+) strand; PAM type: NRG; PAM sequence: TGG
tgcctgtggtcccaggtact

SEQ ID NO: 9676 - DNA, 20 bp, Artificial Sequence
  Description of Artificial Sequence: Synthetic oligonucleotide
  Target: SOD1; (+) strand; PAM type: NRG; PAM sequence: GGG
gcctgtggtcccaggtactt

SEQ ID NO: 9677 - DNA, 20 bp, Artificial Sequence
  Description of Artificial Sequence: Synthetic oligonucleotide
  Target: SOD1; (+) strand; PAM type: NRG; PAM sequence: GAG
ctgtggtcccaggtacttgg

SEQ ID NO: 9678 - DNA, 20 bp, Artificial Sequence
  Description of Artificial Sequence: Synthetic oligonucleotide
  Target: SOD1; (+) strand; PAM type: NRG; PAM sequence: AGG
tgtggtcccaggtacttggg

SEQ ID NO: 9679 - DNA, 20 bp, Artificial Sequence
  Description of Artificial Sequence: Synthetic oligonucleotide
  Target: SOD1; (+) strand; PAM type: NRG; PAM sequence: GAG
tcccaggtacttgggaggct

SEQ ID NO: 9680 - DNA, 20 bp, Artificial Sequence
  Description of Artificial Sequence: Synthetic oligonucleotide
  Target: SOD1; (+) strand; PAM type: NRG; PAM sequence: AGG
cccaggtacttgggaggctg

SEQ ID NO: 9681 - DNA, 20 bp, Artificial Sequence
  Description of Artificial Sequence: Synthetic oligonucleotide
  Target: SOD1; (+) strand; PAM type: NRG; PAM sequence: CAG
aggtacttgggaggctgagg

SEQ ID NO: 9682 - DNA, 20 bp, Artificial Sequence
  Description of Artificial Sequence: Synthetic oligonucleotide
  Target: SOD1; (+) strand; PAM type: NRG; PAM sequence: AGG
ggtacttgggaggctgaggc

SEQ ID NO: 9683 - DNA, 20 bp, Artificial Sequence
  Description of Artificial Sequence: Synthetic oligonucleotide
  Target: SOD1; (+) strand; PAM type: NRG; PAM sequence: GAG
tacttgggaggctgaggcag

SEQ ID NO: 9684 - DNA, 20 bp, Artificial Sequence
  Description of Artificial Sequence: Synthetic oligonucleotide
  Target: SOD1; (+) strand; PAM type: NRG; PAM sequence: AGG
acttgggaggctgaggcagg

SEQ ID NO: 9685 - DNA, 20 bp, Artificial Sequence
  Description of Artificial Sequence: Synthetic oligonucleotide
  Target: SOD1; (+) strand; PAM type: NRG; PAM sequence: TGG
gggaggctgaggcaggagga

SEQ ID NO: 9686 - DNA, 20 bp, Artificial Sequence
  Description of Artificial Sequence: Synthetic oligonucleotide
  Target: SOD1; (+) strand; PAM type: NRG; PAM sequence: CAG
gcaggaggatggcttgaacc

SEQ ID NO: 9687 - DNA, 20 bp, Artificial Sequence
  Description of Artificial Sequence: Synthetic oligonucleotide
  Target: SOD1; (+) strand; PAM type: NRG; PAM sequence: AGG
caggaggatggcttgaaccc

SEQ ID NO: 9688 - DNA, 20 bp, Artificial Sequence
  Description of Artificial Sequence: Synthetic oligonucleotide
  Target: SOD1; (+) strand; PAM type: NRG; PAM sequence: GAG
ggaggatggcttgaacccag

SEQ ID NO: 9689 - DNA, 20 bp, Artificial Sequence
  Description of Artificial Sequence: Synthetic oligonucleotide
  Target: SOD1; (+) strand; PAM type: NRG; PAM sequence: AGG
gaggatggcttgaacccagg

SEQ ID NO: 9690 - DNA, 20 bp, Artificial Sequence
  Description of Artificial Sequence: Synthetic oligonucleotide
  Target: SOD1; (+) strand; PAM type: NRG; PAM sequence: TGG
gatggcttgaacccaggagg

SEQ ID NO: 9691 - DNA, 20 bp, Artificial Sequence
  Description of Artificial Sequence: Synthetic oligonucleotide
  Target: SOD1; (+) strand; PAM type: NRG; PAM sequence: GAG
tggcttgaacccaggaggtg

SEQ ID NO: 9692 - DNA, 20 bp, Artificial Sequence
  Description of Artificial Sequence: Synthetic oligonucleotide
  Target: SOD1; (+) strand; PAM type: NRG; PAM sequence: AGG
ggcttgaacccaggaggtgg

SEQ ID NO: 9693 - DNA, 20 bp, Artificial Sequence
  Description of Artificial Sequence: Synthetic oligonucleotide
  Target: SOD1; (+) strand; PAM type: NRG; PAM sequence: CAG
aacccaggaggtggaggctg

SEQ ID NO: 9694 - DNA, 20 bp, Artificial Sequence
  Description of Artificial Sequence: Synthetic oligonucleotide
  Target: SOD1; (+) strand; PAM type: NRG; PAM sequence: GAG
caggaggtggaggctgcagt

SEQ ID NO: 9695 - DNA, 20 bp, Artificial Sequence
  Description of Artificial Sequence: Synthetic oligonucleotide
  Target: SOD1; (+) strand; PAM type: NRG; PAM sequence: TGG
gaggctgcagtgagctatga

SEQ ID NO: 9696 - DNA, 20 bp, Artificial Sequence
  Description of Artificial Sequence: Synthetic oligonucleotide
  Target: SOD1; (+) strand; PAM type: NRG; PAM sequence: CAG
atgatggcgccactgcactc

SEQ ID NO: 9697 - DNA, 20 bp, Artificial Sequence
  Description of Artificial Sequence: Synthetic oligonucleotide
  Target: SOD1; (+) strand; PAM type: NRG; PAM sequence: TGG
ggcgccactgcactccagcc

SEQ ID NO: 9698 - DNA, 20 bp, Artificial Sequence
  Description of Artificial Sequence: Synthetic oligonucleotide
  Target: SOD1; (+) strand; PAM type: NRG; PAM sequence: GGG
gcgccactgcactccagcct

SEQ ID NO: 9699 - DNA, 20 bp, Artificial Sequence
  Description of Artificial Sequence: Synthetic oligonucleotide
  Target: SOD1; (+) strand; PAM type: NRG; PAM sequence: CAG
ctgcactccagcctgggtga

SEQ ID NO: 9700 - DNA, 20 bp, Artificial Sequence
  Description of Artificial Sequence: Synthetic oligonucleotide
  Target: SOD1; (+) strand; PAM type: NRG; PAM sequence: GAG
gcactccagcctgggtgaca

SEQ ID NO: 9701 - DNA, 20 bp, Artificial Sequence
  Description of Artificial Sequence: Synthetic oligonucleotide
  Target: SOD1; (+) strand; PAM type: NRG; PAM sequence: GAG
tccagcctgggtgacagagc

SEQ ID NO: 9702 - DNA, 20 bp, Artificial Sequence
  Description of Artificial Sequence: Synthetic oligonucleotide
  Target: SOD1; (+) strand; PAM type: NRG; PAM sequence: CGG
aacaaacaaccccctcgccc

SEQ ID NO: 9703 - DNA, 20 bp, Artificial Sequence
  Description of Artificial Sequence: Synthetic oligonucleotide
  Target: SOD1; (+) strand; PAM type: NRG; PAM sequence: AAG
aaccccctcgccccggacaa

SEQ ID NO: 9704 - DNA, 20 bp, Artificial Sequence
  Description of Artificial Sequence: Synthetic oligonucleotide
  Target: SOD1; (+) strand; PAM type: NRG; PAM sequence: TAG
cccctcgccccggacaaaag

SEQ ID NO: 9705 - DNA, 20 bp, Artificial Sequence
  Description of Artificial Sequence: Synthetic oligonucleotide
  Target: SOD1; (+) strand; PAM type: NRG; PAM sequence: AAG
ttttgaaatatttcccttga

SEQ ID NO: 9706 - DNA, 20 bp, Artificial Sequence
  Description of Artificial Sequence: Synthetic oligonucleotide
  Target: SOD1; (+) strand; PAM type: NRG; PAM sequence: AGG
tttgaaatatttcccttgaa

SEQ ID NO: 9707 - DNA, 20 bp, Artificial Sequence
  Description of Artificial Sequence: Synthetic oligonucleotide
  Target: SOD1; (+) strand; PAM type: NRG; PAM sequence: AAG
aaatatttcccttgaaaggt

SEQ ID NO: 9708 - DNA, 20 bp, Artificial Sequence
  Description of Artificial Sequence: Synthetic oligonucleotide
  Target: SOD1; (+) strand; PAM type: NRG; PAM sequence: TGG
tatttatcattcctgttgta

SEQ ID NO: 9709 - DNA, 20 bp, Artificial Sequence
  Description of Artificial Sequence: Synthetic oligonucleotide
  Target: SOD1; (+) strand; PAM type: NRG; PAM sequence: GAG
tttatcattcctgttgtatg

SEQ ID NO: 9710 - DNA, 20 bp, Artificial Sequence
  Description of Artificial Sequence: Synthetic oligonucleotide
  Target: SOD1; (+) strand; PAM type: NRG; PAM sequence: AGG
ttatcattcctgttgtatgg

SEQ ID NO: 9711 - DNA, 20 bp, Artificial Sequence
  Description of Artificial Sequence: Synthetic oligonucleotide
  Target: SOD1; (+) strand; PAM type: NRG; PAM sequence: GAG
ttcaccattctaccctcctt

SEQ ID NO: 9712 - DNA, 20 bp, Artificial Sequence
  Description of Artificial Sequence: Synthetic oligonucleotide
  Target: SOD1; (+) strand; PAM type: NRG; PAM sequence: TGG
tctaccctccttgagtgttg

SEQ ID NO: 9713 - DNA, 20 bp, Artificial Sequence
  Description of Artificial Sequence: Synthetic oligonucleotide
  Target: SOD1; (+) strand; PAM type: NRG; PAM sequence: TAG
tccttgagtgttgtggcctt

SEQ ID NO: 9714 - DNA, 20 bp, Artificial Sequence
  Description of Artificial Sequence: Synthetic oligonucleotide
  Target: SOD1; (+) strand; PAM type: NRG; PAM sequence: AGG
ccttgagtgttgtggccttt

SEQ ID NO: 9715 - DNA, 20 bp, Artificial Sequence
  Description of Artificial Sequence: Synthetic oligonucleotide
  Target: SOD1; (+) strand; PAM type: NRG; PAM sequence: CAG
gagtgttgtggcctttaggc

SEQ ID NO: 9716 - DNA, 20 bp, Artificial Sequence
  Description of Artificial Sequence: Synthetic oligonucleotide
  Target: SOD1; (+) strand; PAM type: NRG; PAM sequence: CAG
ctttaggccagacaaaaacg

SEQ ID NO: 9717 - DNA, 20 bp, Artificial Sequence
  Description of Artificial Sequence: Synthetic oligonucleotide
  Target: SOD1; (+) strand; PAM type: NRG; PAM sequence: AGG
tttaggccagacaaaaacgc

SEQ ID NO: 9718 - DNA, 20 bp, Artificial Sequence
  Description of Artificial Sequence: Synthetic oligonucleotide
  Target: SOD1; (+) strand; PAM type: NRG; PAM sequence: TAG
acaaaaacgcaggtgatgcc

SEQ ID NO: 9719 - DNA, 20 bp, Artificial Sequence
  Description of Artificial Sequence: Synthetic oligonucleotide
  Target: SOD1; (+) strand; PAM type: NRG; PAM sequence: AAG
aaaacgcaggtgatgcctag

SEQ ID NO: 9720 - DNA, 20 bp, Artificial Sequence
  Description of Artificial Sequence: Synthetic oligonucleotide
  Target: SOD1; (+) strand; PAM type: NRG; PAM sequence: TAG
ggtgatgcctagaagccaac

SEQ ID NO: 9721 - DNA, 20 bp, Artificial Sequence
  Description of Artificial Sequence: Synthetic oligonucleotide
  Target: SOD1; (+) strand; PAM type: NRG; PAM sequence: TGG
gaagccaactagttgccgtt

SEQ ID NO: 9722 - DNA, 20 bp, Artificial Sequence
  Description of Artificial Sequence: Synthetic oligonucleotide
  Target: SOD1; (+) strand; PAM type: NRG; PAM sequence: TAG
agttgccgtttggttatctg

SEQ ID NO: 9723 - DNA, 20 bp, Artificial Sequence
  Description of Artificial Sequence: Synthetic oligonucleotide
  Target: SOD1; (+) strand; PAM type: NRG; PAM sequence: AGG
gttgccgtttggttatctgt

SEQ ID NO: 9724 - DNA, 20 bp, Artificial Sequence
  Description of Artificial Sequence: Synthetic oligonucleotide
  Target: SOD1; (+) strand; PAM type: NRG; PAM sequence: GGG
ttgccgtttggttatctgta

SEQ ID NO: 9725 - DNA, 20 bp, Artificial Sequence
  Description of Artificial Sequence: Synthetic oligonucleotide
  Target: SOD1; (+) strand; PAM type: NRG; PAM sequence: TGG
tttggttatctgtagggttg

SEQ ID NO: 9726 - DNA, 20 bp, Artificial Sequence
  Description of Artificial Sequence: Synthetic oligonucleotide
  Target: SOD1; (+) strand; PAM type: NRG; PAM sequence: CAG
agggttgtggccttgccaaa

SEQ ID NO: 9727 - DNA, 20 bp, Artificial Sequence
  Description of Artificial Sequence: Synthetic oligonucleotide
  Target: SOD1; (+) strand; PAM type: NRG; PAM sequence: AGG
gggttgtggccttgccaaac

SEQ ID NO: 9728 - DNA, 20 bp, Artificial Sequence
  Description of Artificial Sequence: Synthetic oligonucleotide
  Target: SOD1; (+) strand; PAM type: NRG; PAM sequence: AAG
ccaaacaggaaaaatataaa

SEQ ID NO: 9729 - DNA, 20 bp, Artificial Sequence
  Description of Artificial Sequence: Synthetic oligonucleotide
  Target: SOD1; (+) strand; PAM type: NRG; PAM sequence: AAG
ccgaattctgccaaccaaat

SEQ ID NO: 9730 - DNA, 20 bp, Artificial Sequence
  Description of Artificial Sequence: Synthetic oligonucleotide
  Target: SOD1; (+) strand; PAM type: NRG; PAM sequence: AAG
caaataagaaactctatact

SEQ ID NO: 9731 - DNA, 20 bp, Artificial Sequence
  Description of Artificial Sequence: Synthetic oligonucleotide
  Target: SOD1; (+) strand; PAM type: NRG; PAM sequence: AGG
aaataagaaactctatacta

SEQ ID NO: 9732 - DNA, 20 bp, Artificial Sequence
  Description of Artificial Sequence: Synthetic oligonucleotide
  Target: SOD1; (+) strand; PAM type: NRG; PAM sequence: AAG
gaaactctatactaaggact

SEQ ID NO: 9733 - DNA, 20 bp, Artificial Sequence
  Description of Artificial Sequence: Synthetic oligonucleotide
  Target: SOD1; (+) strand; PAM type: NRG; PAM sequence: CAG
actaaggactaagaaaattg

SEQ ID NO: 9734 - DNA, 20 bp, Artificial Sequence
  Description of Artificial Sequence: Synthetic oligonucleotide
  Target: SOD1; (+) strand; PAM type: NRG; PAM sequence: AGG
ctaaggactaagaaaattgc

SEQ ID NO: 9735 - DNA, 20 bp, Artificial Sequence
  Description of Artificial Sequence: Synthetic oligonucleotide
  Target: SOD1; (+) strand; PAM type: NRG; PAM sequence: GGG
taaggactaagaaaattgca

SEQ ID NO: 9736 - DNA, 20 bp, Artificial Sequence
  Description of Artificial Sequence: Synthetic oligonucleotide
  Target: SOD1; (+) strand; PAM type: NRG; PAM sequence: GGG
aaggactaagaaaattgcag

SEQ ID NO: 9737 - DNA, 20 bp, Artificial Sequence
  Description of Artificial Sequence: Synthetic oligonucleotide
  Target: SOD1; (+) strand; PAM type: NRG; PAM sequence: AAG
gactaagaaaattgcagggg

SEQ ID NO: 9738 - DNA, 20 bp, Artificial Sequence
  Description of Artificial Sequence: Synthetic oligonucleotide
  Target: SOD1; (+) strand; PAM type: NRG; PAM sequence: AAG
agaaaattgcaggggaagaa

SEQ ID NO: 9739 - DNA, 20 bp, Artificial Sequence
  Description of Artificial Sequence: Synthetic oligonucleotide
  Target: SOD1; (+) strand; PAM type: NRG; PAM sequence: AGG
gaaaattgcaggggaagaaa

SEQ ID NO: 9740 - DNA, 20 bp, Artificial Sequence
  Description of Artificial Sequence: Synthetic oligonucleotide
  Target: SOD1; (+) strand; PAM type: NRG; PAM sequence: AAG
attgcaggggaagaaaaggt

SEQ ID NO: 9741 - DNA, 20 bp, Artificial Sequence
  Description of Artificial Sequence: Synthetic oligonucleotide
  Target: SOD1; (+) strand; PAM type: NRG; PAM sequence: CGG
ggggaagaaaaggtaagtcc

SEQ ID NO: 9742 - DNA, 20 bp, Artificial Sequence
  Description of Artificial Sequence: Synthetic oligonucleotide
  Target: SOD1; (+) strand; PAM type: NRG; PAM sequence: GGG
gggaagaaaaggtaagtccc

SEQ ID NO: 9743 - DNA, 20 bp, Artificial Sequence
  Description of Artificial Sequence: Synthetic oligonucleotide
  Target: SOD1; (+) strand; PAM type: NRG; PAM sequence: GAG
aaaaggtaagtcccgggatt

SEQ ID NO: 9744 - DNA, 20 bp, Artificial Sequence
  Description of Artificial Sequence: Synthetic oligonucleotide
  Target: SOD1; (+) strand; PAM type: NRG; PAM sequence: AGG
aaaggtaagtcccgggattg

SEQ ID NO: 9745 - DNA, 20 bp, Artificial Sequence
  Description of Artificial Sequence: Synthetic oligonucleotide
  Target: SOD1; (+) strand; PAM type: NRG; PAM sequence: TAG
taagtcccgggattgaggtg

SEQ ID NO: 9746 - DNA, 20 bp, Artificial Sequence
  Description of Artificial Sequence: Synthetic oligonucleotide
  Target: SOD1; (+) strand; PAM type: NRG; PAM sequence: CAG
gtagcgactttctataccct

SEQ ID NO: 9747 - DNA, 20 bp, Artificial Sequence
  Description of Artificial Sequence: Synthetic oligonucleotide
  Target: SOD1; (+) strand; PAM type: NRG; PAM sequence: AAG
ccctcagaaaactaaaaaac

SEQ ID NO: 9748 - DNA, 20 bp, Artificial Sequence
  Description of Artificial Sequence: Synthetic oligonucleotide
  Target: SOD1; (+) strand; PAM type: NRG; PAM sequence: AAG
caaaaaaatgaaaactacaa

SEQ ID NO: 9749 - DNA, 20 bp, Artificial Sequence
  Description of Artificial Sequence: Synthetic oligonucleotide
  Target: SOD1; (+) strand; PAM type: NRG; PAM sequence: TGG
aactacaaaagcatccatct

SEQ ID NO: 9750 - DNA, 20 bp, Artificial Sequence
  Description of Artificial Sequence: Synthetic oligonucleotide
  Target: SOD1; (+) strand; PAM type: NRG; PAM sequence: GGG
actacaaaagcatccatctt

SEQ ID NO: 9751 - DNA, 20 bp, Artificial Sequence
  Description of Artificial Sequence: Synthetic oligonucleotide
  Target: SOD1; (+) strand; PAM type: NRG; PAM sequence: GGG
ctacaaaagcatccatcttg

SEQ ID NO: 9752 - DNA, 20 bp, Artificial Sequence
  Description of Artificial Sequence: Synthetic oligonucleotide
  Target: SOD1; (+) strand; PAM type: NRG; PAM sequence: GAG
cttggggcgtcccaattgct

SEQ ID NO: 9753 - DNA, 20 bp, Artificial Sequence
  Description of Artificial Sequence: Synthetic oligonucleotide
  Target: SOD1; (+) strand; PAM type: NRG; PAM sequence: GAG
ccaattgctgagtaacaaat

SEQ ID NO: 9754 - DNA, 20 bp, Artificial Sequence
  Description of Artificial Sequence: Synthetic oligonucleotide
  Target: SOD1; (+) strand; PAM type: NRG; PAM sequence: TGG
gagtaacaaatgagacgctg

SEQ ID NO: 9755 - DNA, 20 bp, Artificial Sequence
  Description of Artificial Sequence: Synthetic oligonucleotide
  Target: SOD1; (+) strand; PAM type: NRG; PAM sequence: CAG
tgagacgctgtggccaaact

SEQ ID NO: 9756 - DNA, 20 bp, Artificial Sequence
  Description of Artificial Sequence: Synthetic oligonucleotide
  Target: SOD1; (+) strand; PAM type: NRG; PAM sequence: TAG
gtcataactaatgacatttc

SEQ ID NO: 9757 - DNA, 20 bp, Artificial Sequence
  Description of Artificial Sequence: Synthetic oligonucleotide
  Target: SOD1; (+) strand; PAM type: NRG; PAM sequence: AAG
actaatgacatttctagaca

SEQ ID NO: 9758 - DNA, 20 bp, Artificial Sequence
  Description of Artificial Sequence: Synthetic oligonucleotide
  Target: SOD1; (+) strand; PAM type: NRG; PAM sequence: CAG
atttctagacaaagtgactt

SEQ ID NO: 9759 - DNA, 20 bp, Artificial Sequence
  Description of Artificial Sequence: Synthetic oligonucleotide
  Target: SOD1; (+) strand; PAM type: NRG; PAM sequence: AAG
aaagtgacttcagattttca

SEQ ID NO: 9760 - DNA, 20 bp, Artificial Sequence
  Description of Artificial Sequence: Synthetic oligonucleotide
  Target: SOD1; (+) strand; PAM type: NRG; PAM sequence: CGG
ccaatttcgcgtactgcaac

SEQ ID NO: 9761 - DNA, 20 bp, Artificial Sequence
  Description of Artificial Sequence: Synthetic oligonucleotide
  Target: SOD1; (+) strand; PAM type: NRG; PAM sequence: CGG
atttcgcgtactgcaaccgg

SEQ ID NO: 9762 - DNA, 20 bp, Artificial Sequence
  Description of Artificial Sequence: Synthetic oligonucleotide
  Target: SOD1; (+) strand; PAM type: NRG; PAM sequence: GGG
tttcgcgtactgcaaccggc

SEQ ID NO: 9763 - DNA, 20 bp, Artificial Sequence
  Description of Artificial Sequence: Synthetic oligonucleotide
  Target: SOD1; (+) strand; PAM type: NRG; PAM sequence: AAG
gcgggccacgcccccgtgaa

SEQ ID NO: 9764 - DNA, 20 bp, Artificial Sequence
  Description of Artificial Sequence: Synthetic oligonucleotide
  Target: SOD1; (+) strand; PAM type: NRG; PAM sequence: AAG
ggccacgcccccgtgaaaag

SEQ ID NO: 9765 - DNA, 20 bp, Artificial Sequence
  Description of Artificial Sequence: Synthetic oligonucleotide
  Target: SOD1; (+) strand; PAM type: NRG; PAM sequence: AGG
gccacgcccccgtgaaaaga

SEQ ID NO: 9766 - DNA, 20 bp, Artificial Sequence
  Description of Artificial Sequence: Synthetic oligonucleotide
  Target: SOD1; (+) strand; PAM type: NRG; PAM sequence: CGG
aggttgttttctccacattt

SEQ ID NO: 9767 - DNA, 20 bp, Artificial Sequence
  Description of Artificial Sequence: Synthetic oligonucleotide
  Target: SOD1; (+) strand; PAM type: NRG; PAM sequence: GGG
ggttgttttctccacatttc

SEQ ID NO: 9768 - DNA, 20 bp, Artificial Sequence
  Description of Artificial Sequence: Synthetic oligonucleotide
  Target: SOD1; (+) strand; PAM type: NRG; PAM sequence: GGG
gttgttttctccacatttcg

SEQ ID NO: 9769 - DNA, 20 bp, Artificial Sequence
  Description of Artificial Sequence: Synthetic oligonucleotide
  Target: SOD1; (+) strand; PAM type: NRG; PAM sequence: TGG
ttctccacatttcggggttc

SEQ ID NO: 9770 - DNA, 20 bp, Artificial Sequence
  Description of Artificial Sequence: Synthetic oligonucleotide
  Target: SOD1; (+) strand; PAM type: NRG; PAM sequence: CGG
tcggggttctggacgtttcc

SEQ ID NO: 9771 - DNA, 20 bp, Artificial Sequence
  Description of Artificial Sequence: Synthetic oligonucleotide
  Target: SOD1; (+) strand; PAM type: NRG; PAM sequence: CGG
ttctggacgtttcccggctg

SEQ ID NO: 9772 - DNA, 20 bp, Artificial Sequence
  Description of Artificial Sequence: Synthetic oligonucleotide
  Target: SOD1; (+) strand; PAM type: NRG; PAM sequence: GGG
tctggacgtttcccggctgc

SEQ ID NO: 9773 - DNA, 20 bp, Artificial Sequence
  Description of Artificial Sequence: Synthetic oligonucleotide
  Target: SOD1; (+) strand; PAM type: NRG; PAM sequence: GGG
ctggacgtttcccggctgcg

SEQ ID NO: 9774 - DNA, 20 bp, Artificial Sequence
  Description of Artificial Sequence: Synthetic oligonucleotide
  Target: SOD1; (+) strand; PAM type: NRG; PAM sequence: CGG
gacgtttcccggctgcgggg

SEQ ID NO: 9775 - DNA, 20 bp, Artificial Sequence
  Description of Artificial Sequence: Synthetic oligonucleotide
  Target: SOD1; (+) strand; PAM type: NRG; PAM sequence: GGG
acgtttcccggctgcggggc

SEQ ID NO: 9776 - DNA, 20 bp, Artificial Sequence
  Description of Artificial Sequence: Synthetic oligonucleotide
  Target: SOD1; (+) strand; PAM type: NRG; PAM sequence: GGG
cgtttcccggctgcggggcg

SEQ ID NO: 9777 - DNA, 20 bp, Artificial Sequence
  Description of Artificial Sequence: Synthetic oligonucleotide
  Target: SOD1; (+) strand; PAM type: NRG; PAM sequence: GGG
gtttcccggctgcggggcgg

SEQ ID NO: 9778 - DNA, 20 bp, Artificial Sequence
  Description of Artificial Sequence: Synthetic oligonucleotide
  Target: SOD1; (+) strand; PAM type: NRG; PAM sequence: GGG
tttcccggctgcggggcggg

SEQ ID NO: 9779 - DNA, 20 bp, Artificial Sequence
  Description of Artificial Sequence: Synthetic oligonucleotide
  Target: SOD1; (+) strand; PAM type: NRG; PAM sequence: GAG
tcccggctgcggggcggggg

SEQ ID NO: 9780 - DNA, 20 bp, Artificial Sequence
  Description of Artificial Sequence: Synthetic oligonucleotide
  Target: SOD1; (+) strand; PAM type: NRG; PAM sequence: CGG
tgcggggcggggggagtctc

SEQ ID NO: 9781 - DNA, 20 bp, Artificial Sequence
  Description of Artificial Sequence: Synthetic oligonucleotide
  Target: SOD1; (+) strand; PAM type: NRG; PAM sequence: CGG
gggggagtctccggcgcacg

SEQ ID NO: 9782 - DNA, 20 bp, Artificial Sequence
  Description of Artificial Sequence: Synthetic oligonucleotide
  Target: SOD1; (+) strand; PAM type: NRG; PAM sequence: TGG
ctccggcgcacgcggcccct

SEQ ID NO: 9783 - DNA, 20 bp, Artificial Sequence
  Description of Artificial Sequence: Synthetic oligonucleotide
  Target: SOD1; (+) strand; PAM type: NRG; PAM sequence: CAG
cggccccttggccccgcccc

SEQ ID NO: 9784 - DNA, 20 bp, Artificial Sequence
  Description of Artificial Sequence: Synthetic oligonucleotide
  Target: SOD1; (+) strand; PAM type: NRG; PAM sequence: CGG
gccccgcccccagtcattcc

SEQ ID NO: 9785 - DNA, 20 bp, Artificial Sequence
  Description of Artificial Sequence: Synthetic oligonucleotide
  Target: SOD1; (+) strand; PAM type: NRG; PAM sequence: GAG
ttcccggccactcgcgaccc

SEQ ID NO: 9786 - DNA, 20 bp, Artificial Sequence
  Description of Artificial Sequence: Synthetic oligonucleotide
  Target: SOD1; (+) strand; PAM type: NRG; PAM sequence: AGG
tcccggccactcgcgacccg

SEQ ID NO: 9787 - DNA, 20 bp, Artificial Sequence
  Description of Artificial Sequence: Synthetic oligonucleotide
  Target: SOD1; (+) strand; PAM type: NRG; PAM sequence: CAG
ctcgcgacccgaggctgccg

SEQ ID NO: 9788 - DNA, 20 bp, Artificial Sequence
  Description of Artificial Sequence: Synthetic oligonucleotide
  Target: SOD1; (+) strand; PAM type: NRG; PAM sequence: AGG
tcgcgacccgaggctgccgc

SEQ ID NO: 9789 - DNA, 20 bp, Artificial Sequence
  Description of Artificial Sequence: Synthetic oligonucleotide
  Target: SOD1; (+) strand; PAM type: NRG; PAM sequence: GGG
cgcgacccgaggctgccgca

SEQ ID NO: 9790 - DNA, 20 bp, Artificial Sequence
  Description of Artificial Sequence: Synthetic oligonucleotide
  Target: SOD1; (+) strand; PAM type: NRG; PAM sequence: GGG
gcgacccgaggctgccgcag

SEQ ID NO: 9791 - DNA, 20 bp, Artificial Sequence
  Description of Artificial Sequence: Synthetic oligonucleotide
  Target: SOD1; (+) strand; PAM type: NRG; PAM sequence: GGG
cgacccgaggctgccgcagg

SEQ ID NO: 9792 - DNA, 20 bp, Artificial Sequence
  Description of Artificial Sequence: Synthetic oligonucleotide
  Target: SOD1; (+) strand; PAM type: NRG; PAM sequence: CGG
cccgaggctgccgcaggggg

SEQ ID NO: 9793 - DNA, 20 bp, Artificial Sequence
  Description of Artificial Sequence: Synthetic oligonucleotide
  Target: SOD1; (+) strand; PAM type: NRG; PAM sequence: GGG
ccgaggctgccgcagggggc

SEQ ID NO: 9794 - DNA, 20 bp, Artificial Sequence
  Description of Artificial Sequence: Synthetic oligonucleotide
  Target: SOD1; (+) strand; PAM type: NRG; PAM sequence: GAG
gctgccgcagggggcgggct

SEQ ID NO: 9795 - DNA, 20 bp, Artificial Sequence
  Description of Artificial Sequence: Synthetic oligonucleotide
  Target: SOD1; (+) strand; PAM type: NRG; PAM sequence: GAG
ggggcgggctgagcgcgtgc

SEQ ID NO: 9796 - DNA, 20 bp, Artificial Sequence
  Description of Artificial Sequence: Synthetic oligonucleotide
  Target: SOD1; (+) strand; PAM type: NRG; PAM sequence: AGG
gggcgggctgagcgcgtgcg

SEQ ID NO: 9797 - DNA, 20 bp, Artificial Sequence
  Description of Artificial Sequence: Synthetic oligonucleotide
  Target: SOD1; (+) strand; PAM type: NRG; PAM sequence: TGG
ctgagcgcgtgcgaggcgat

SEQ ID NO: 9798 - DNA, 20 bp, Artificial Sequence
  Description of Artificial Sequence: Synthetic oligonucleotide
  Target: SOD1; (+) strand; PAM type: NRG; PAM sequence: TGG
cgcgtgcgaggcgattggtt

SEQ ID NO: 9799 - DNA, 20 bp, Artificial Sequence
  Description of Artificial Sequence: Synthetic oligonucleotide
  Target: SOD1; (+) strand; PAM type: NRG; PAM sequence: GGG
gcgtgcgaggcgattggttt

SEQ ID NO: 9800 - DNA, 20 bp, Artificial Sequence
  Description of Artificial Sequence: Synthetic oligonucleotide
  Target: SOD1; (+) strand; PAM type: NRG; PAM sequence: GGG
cgtgcgaggcgattggtttg

SEQ ID NO: 9801 - DNA, 20 bp, Artificial Sequence
  Description of Artificial Sequence: Synthetic oligonucleotide
  Target: SOD1; (+) strand; PAM type: NRG; PAM sequence: CAG
cgaggcgattggtttggggc

SEQ ID NO: 9802 - DNA, 20 bp, Artificial Sequence
  Description of Artificial Sequence: Synthetic oligonucleotide
  Target: SOD1; (+) strand; PAM type: NRG; PAM sequence: GAG
aggcgattggtttggggcca

SEQ ID NO: 9803 - DNA, 20 bp, Artificial Sequence
  Description of Artificial Sequence: Synthetic oligonucleotide
  Target: SOD1; (+) strand; PAM type: NRG; PAM sequence: TGG
cgattggtttggggccagag

SEQ ID NO: 9804 - DNA, 20 bp, Artificial Sequence
  Description of Artificial Sequence: Synthetic oligonucleotide
  Target: SOD1; (+) strand; PAM type: NRG; PAM sequence: GGG
gattggtttggggccagagt

SEQ ID NO: 9805 - DNA, 20 bp, Artificial Sequence
  Description of Artificial Sequence: Synthetic oligonucleotide
  Target: SOD1; (+) strand; PAM type: NRG; PAM sequence: GAG
ggtttggggccagagtgggc

SEQ ID NO: 9806 - DNA, 20 bp, Artificial Sequence
  Description of Artificial Sequence: Synthetic oligonucleotide
  Target: SOD1; (+) strand; PAM type: NRG; PAM sequence: AGG
gtttggggccagagtgggcg

SEQ ID NO: 9807 - DNA, 20 bp, Artificial Sequence
  Description of Artificial Sequence: Synthetic oligonucleotide
  Target: SOD1; (+) strand; PAM type: NRG; PAM sequence: CGG
gggccagagtgggcgaggcg

SEQ ID NO: 9808 - DNA, 20 bp, Artificial Sequence
  Description of Artificial Sequence: Synthetic oligonucleotide
  Target: SOD1; (+) strand; PAM type: NRG; PAM sequence: GAG
gccagagtgggcgaggcgcg

SEQ ID NO: 9809 - DNA, 20 bp, Artificial Sequence
  Description of Artificial Sequence: Synthetic oligonucleotide
  Target: SOD1; (+) strand; PAM type: NRG; PAM sequence: AGG
ccagagtgggcgaggcgcgg

SEQ ID NO: 9810 - DNA, 20 bp, Artificial Sequence
  Description of Artificial Sequence: Synthetic oligonucleotide
  Target: SOD1; (+) strand; PAM type: NRG; PAM sequence: TGG
gtgggcgaggcgcggaggtc

SEQ ID NO: 9811 - DNA, 20 bp, Artificial Sequence
  Description of Artificial Sequence: Synthetic oligonucleotide
  Target: SOD1; (+) strand; PAM type: NRG; PAM sequence: AAG
gcgcggaggtctggcctata

SEQ ID NO: 9812 - DNA, 20 bp, Artificial Sequence
  Description of Artificial Sequence: Synthetic oligonucleotide
  Target: SOD1; (+) strand; PAM type: NRG; PAM sequence: TAG
cggaggtctggcctataaag

SEQ ID NO: 9813 - DNA, 20 bp, Artificial Sequence
  Description of Artificial Sequence: Synthetic oligonucleotide
  Target: SOD1; (+) strand; PAM type: NRG; PAM sequence: CGG
tctggcctataaagtagtcg

SEQ ID NO: 9814 - DNA, 20 bp, Artificial Sequence
  Description of Artificial Sequence: Synthetic oligonucleotide
  Target: SOD1; (+) strand; PAM type: NRG; PAM sequence: GAG
tggcctataaagtagtcgcg

SEQ ID NO: 9815 - DNA, 20 bp, Artificial Sequence
  Description of Artificial Sequence: Synthetic oligonucleotide
  Target: SOD1; (+) strand; PAM type: NRG; PAM sequence: CGG
ctataaagtagtcgcggaga

SEQ ID NO: 9816 - DNA, 20 bp, Artificial Sequence
  Description of Artificial Sequence: Synthetic oligonucleotide
  Target: SOD1; (+) strand; PAM type: NRG; PAM sequence: GGG
tataaagtagtcgcggagac

SEQ ID NO: 9817 - DNA, 20 bp, Artificial Sequence
  Description of Artificial Sequence: Synthetic oligonucleotide
  Target: SOD1; (+) strand; PAM type: NRG; PAM sequence: GGG
ataaagtagtcgcggagacg

SEQ ID NO: 9818 - DNA, 20 bp, Artificial Sequence
  Description of Artificial Sequence: Synthetic oligonucleotide
  Target: SOD1; (+) strand; PAM type: NRG; PAM sequence: TGG
tagtcgcggagacggggtgc

SEQ ID NO: 9819 - DNA, 20 bp, Artificial Sequence
  Description of Artificial Sequence: Synthetic oligonucleotide
  Target: SOD1; (+) strand; PAM type: NRG; PAM sequence: TAG
cggggtgctggtttgcgtcg

SEQ ID NO: 9820 - DNA, 20 bp, Artificial Sequence
  Description of Artificial Sequence: Synthetic oligonucleotide
  Target: SOD1; (+) strand; PAM type: NRG; PAM sequence: CAG
gtttgcgtcgtagtctcctg

SEQ ID NO: 9821 - DNA, 20 bp, Artificial Sequence
  Description of Artificial Sequence: Synthetic oligonucleotide
  Target: SOD1; (+) strand; PAM type: NRG; PAM sequence: TGG
tcgtagtctcctgcagcgtc

SEQ ID NO: 9822 - DNA, 20 bp, Artificial Sequence
  Description of Artificial Sequence: Synthetic oligonucleotide
  Target: SOD1; (+) strand; PAM type: NRG; PAM sequence: GGG
cgtagtctcctgcagcgtct

SEQ ID NO: 9823 - DNA, 20 bp, Artificial Sequence
  Description of Artificial Sequence: Synthetic oligonucleotide
  Target: SOD1; (+) strand; PAM type: NRG; PAM sequence: GGG
gtagtctcctgcagcgtctg

SEQ ID NO: 9824 - DNA, 20 bp, Artificial Sequence
  Description of Artificial Sequence: Synthetic oligonucleotide
  Target: SOD1; (+) strand; PAM type: NRG; PAM sequence: CAG
agcgtctggggtttccgttg

SEQ ID NO: 9825 - DNA, 20 bp, Artificial Sequence
  Description of Artificial Sequence: Synthetic oligonucleotide
  Target: SOD1; (+) strand; PAM type: NRG; PAM sequence: CGG
ggggtttccgttgcagtcct

SEQ ID NO: 9826 - DNA, 20 bp, Artificial Sequence
  Description of Artificial Sequence: Synthetic oligonucleotide
  Target: SOD1; (+) strand; PAM type: NRG; PAM sequence: CAG
tccgttgcagtcctcggaac

SEQ ID NO: 9827 - DNA, 20 bp, Artificial Sequence
  Description of Artificial Sequence: Synthetic oligonucleotide
  Target: SOD1; (+) strand; PAM type: NRG; PAM sequence: AGG
ccgttgcagtcctcggaacc

SEQ ID NO: 9828 - DNA, 20 bp, Artificial Sequence
  Description of Artificial Sequence: Synthetic oligonucleotide
  Target: SOD1; (+) strand; PAM type: NRG; PAM sequence: CGG
agtcctcggaaccaggacct

SEQ ID NO: 9829 - DNA, 20 bp, Artificial Sequence
  Description of Artificial Sequence: Synthetic oligonucleotide
  Target: SOD1; (+) strand; PAM type: NRG; PAM sequence: TGG
tcggaaccaggacctcggcg

SEQ ID NO: 9830 - DNA, 20 bp, Artificial Sequence
  Description of Artificial Sequence: Synthetic oligonucleotide
  Target: SOD1; (+) strand; PAM type: NRG; PAM sequence: TAG
accaggacctcggcgtggcc

SEQ ID NO: 9831 - DNA, 20 bp, Artificial Sequence
  Description of Artificial Sequence: Synthetic oligonucleotide
  Target: SOD1; (+) strand; PAM type: NRG; PAM sequence: GAG
ggacctcggcgtggcctagc

SEQ ID NO: 9832 - DNA, 20 bp, Artificial Sequence
  Description of Artificial Sequence: Synthetic oligonucleotide
  Target: SOD1; (+) strand; PAM type: NRG; PAM sequence: TGG
cggcgtggcctagcgagtta

SEQ ID NO: 9833 - DNA, 20 bp, Artificial Sequence
  Description of Artificial Sequence: Synthetic oligonucleotide
  Target: SOD1; (+) strand; PAM type: NRG; PAM sequence: AAG
cctagcgagttatggcgacg

SEQ ID NO: 9834 - DNA, 20 bp, Artificial Sequence
  Description of Artificial Sequence: Synthetic oligonucleotide
  Target: SOD1; (+) strand; PAM type: NRG; PAM sequence: AGG
ctagcgagttatggcgacga

SEQ ID NO: 9835 - DNA, 20 bp, Artificial Sequence
  Description of Artificial Sequence: Synthetic oligonucleotide
  Target: SOD1; (+) strand; PAM type: NRG; PAM sequence: AAG
cgaaggccgtgtgcgtgctg

SEQ ID NO: 9836 - DNA, 20 bp, Artificial Sequence
  Description of Artificial Sequence: Synthetic oligonucleotide
  Target: SOD1; (+) strand; PAM type: NRG; PAM sequence: AGG
gaaggccgtgtgcgtgctga

SEQ ID NO: 9837 - DNA, 20 bp, Artificial Sequence
  Description of Artificial Sequence: Synthetic oligonucleotide
  Target: SOD1; (+) strand; PAM type: NRG; PAM sequence: GGG
aaggccgtgtgcgtgctgaa

SEQ ID NO: 9838 - DNA, 20 bp, Artificial Sequence
  Description of Artificial Sequence: Synthetic oligonucleotide
  Target: SOD1; (+) strand; PAM type: NRG; PAM sequence: CGG
gtgtgcgtgctgaagggcga

SEQ ID NO: 9839 - DNA, 20 bp, Artificial Sequence
  Description of Artificial Sequence: Synthetic oligonucleotide
  Target: SOD1; (+) strand; PAM type: NRG; PAM sequence: CAG
cgtgctgaagggcgacggcc

SEQ ID NO: 9840 - DNA, 20 bp, Artificial Sequence
  Description of Artificial Sequence: Synthetic oligonucleotide
  Target: SOD1; (+) strand; PAM type: NRG; PAM sequence: CAG
tgaagggcgacggcccagtg

SEQ ID NO: 9841 - DNA, 20 bp, Artificial Sequence
  Description of Artificial Sequence: Synthetic oligonucleotide
  Target: SOD1; (+) strand; PAM type: NRG; PAM sequence: AGG
gaagggcgacggcccagtgc

SEQ ID NO: 9842 - DNA, 20 bp, Artificial Sequence
  Description of Artificial Sequence: Synthetic oligonucleotide
  Target: SOD1; (+) strand; PAM type: NRG; PAM sequence: GGG
aagggcgacggcccagtgca

SEQ ID NO: 9843 - DNA, 20 bp, Artificial Sequence
  Description of Artificial Sequence: Synthetic oligonucleotide
  Target: SOD1; (+) strand; PAM type: NRG; PAM sequence: GAG
tgcagggcatcatcaatttc

SEQ ID NO: 9844 - DNA, 20 bp, Artificial Sequence
  Description of Artificial Sequence: Synthetic oligonucleotide
  Target: SOD1; (+) strand; PAM type: NRG; PAM sequence: CAG
agggcatcatcaatttcgag

SEQ ID NO: 9845 - DNA, 20 bp, Artificial Sequence
  Description of Artificial Sequence: Synthetic oligonucleotide
  Target: SOD1; (+) strand; PAM type: NRG; PAM sequence: AAG
gcatcatcaatttcgagcag

SEQ ID NO: 9846 - DNA, 20 bp, Artificial Sequence
  Description of Artificial Sequence: Synthetic oligonucleotide
  Target: SOD1; (+) strand; PAM type: NRG; PAM sequence: AGG
catcatcaatttcgagcaga

SEQ ID NO: 9847 - DNA, 20 bp, Artificial Sequence
  Description of Artificial Sequence: Synthetic oligonucleotide
  Target: SOD1; (+) strand; PAM type: NRG; PAM sequence: AAG
atcaatttcgagcagaaggc

SEQ ID NO: 9848 - DNA, 20 bp, Artificial Sequence
  Description of Artificial Sequence: Synthetic oligonucleotide
  Target: SOD1; (+) strand; PAM type: NRG; PAM sequence: AGG
tcaatttcgagcagaaggca

SEQ ID NO: 9849 - DNA, 20 bp, Artificial Sequence
  Description of Artificial Sequence: Synthetic oligonucleotide
  Target: SOD1; (+) strand; PAM type: NRG; PAM sequence: GGG
caatttcgagcagaaggcaa

SEQ ID NO: 9850 - DNA, 20 bp, Artificial Sequence
  Description of Artificial Sequence: Synthetic oligonucleotide
  Target: SOD1; (+) strand; PAM type: NRG; PAM sequence: TGG
ttcgagcagaaggcaagggc

SEQ ID NO: 9851 - DNA, 20 bp, Artificial Sequence
  Description of Artificial Sequence: Synthetic oligonucleotide
  Target: SOD1; (+) strand; PAM type: NRG; PAM sequence: GGG
tcgagcagaaggcaagggct

SEQ ID NO: 9852 - DNA, 20 bp, Artificial Sequence
  Description of Artificial Sequence: Synthetic oligonucleotide
  Target: SOD1; (+) strand; PAM type: NRG; PAM sequence: CGG
gcagaaggcaagggctggga

SEQ ID NO: 9853 - DNA, 20 bp, Artificial Sequence
  Description of Artificial Sequence: Synthetic oligonucleotide
  Target: SOD1; (+) strand; PAM type: NRG; PAM sequence: GAG
agaaggcaagggctgggacg

SEQ ID NO: 9854 - DNA, 20 bp, Artificial Sequence
  Description of Artificial Sequence: Synthetic oligonucleotide
  Target: SOD1; (+) strand; PAM type: NRG; PAM sequence: AGG
gaaggcaagggctgggacgg

SEQ ID NO: 9855 - DNA, 20 bp, Artificial Sequence
  Description of Artificial Sequence: Synthetic oligonucleotide
  Target: SOD1; (+) strand; PAM type: NRG; PAM sequence: GAG
tgggacggaggcttgtttgc

SEQ ID NO: 9856 - DNA, 20 bp, Artificial Sequence
  Description of Artificial Sequence: Synthetic oligonucleotide
  Target: SOD1; (+) strand; PAM type: NRG; PAM sequence: AGG
gggacggaggcttgtttgcg

SEQ ID NO: 9857 - DNA, 20 bp, Artificial Sequence
  Description of Artificial Sequence: Synthetic oligonucleotide
  Target: SOD1; (+) strand; PAM type: NRG; PAM sequence: TAG
gtccccccgcgcacctttgc

SEQ ID NO: 9858 - DNA, 20 bp, Artificial Sequence
  Description of Artificial Sequence: Synthetic oligonucleotide
  Target: SOD1; (+) strand; PAM type: NRG; PAM sequence: AGG
tccccccgcgcacctttgct

SEQ ID NO: 9859 - DNA, 20 bp, Artificial Sequence
  Description of Artificial Sequence: Synthetic oligonucleotide
  Target: SOD1; (+) strand; PAM type: NRG; PAM sequence: GAG
cccccgcgcacctttgctag

SEQ ID NO: 9860 - DNA, 20 bp, Artificial Sequence
  Description of Artificial Sequence: Synthetic oligonucleotide
  Target: SOD1; (+) strand; PAM type: NRG; PAM sequence: CGG
ccgcgcacctttgctaggag

SEQ ID NO: 9861 - DNA, 20 bp, Artificial Sequence
  Description of Artificial Sequence: Synthetic oligonucleotide
  Target: SOD1; (+) strand; PAM type: NRG; PAM sequence: GGG
cgcgcacctttgctaggagc

SEQ ID NO: 9862 - DNA, 20 bp, Artificial Sequence
  Description of Artificial Sequence: Synthetic oligonucleotide
  Target: SOD1; (+) strand; PAM type: NRG; PAM sequence: CAG
gctaggagcgggtcgcccgc

SEQ ID NO: 9863 - DNA, 20 bp, Artificial Sequence
  Description of Artificial Sequence: Synthetic oligonucleotide
  Target: SOD1; (+) strand; PAM type: NRG; PAM sequence: AGG
ctaggagcgggtcgcccgcc

SEQ ID NO: 9864 - DNA, 20 bp, Artificial Sequence
  Description of Artificial Sequence: Synthetic oligonucleotide
  Target: SOD1; (+) strand; PAM type: NRG; PAM sequence: CGG
gcgggtcgcccgccaggcct

SEQ ID NO: 9865 - DNA, 20 bp, Artificial Sequence
  Description of Artificial Sequence: Synthetic oligonucleotide
  Target: SOD1; (+) strand; PAM type: NRG; PAM sequence: GGG
cgggtcgcccgccaggcctc

SEQ ID NO: 9866 - DNA, 20 bp, Artificial Sequence
  Description of Artificial Sequence: Synthetic oligonucleotide
  Target: SOD1; (+) strand; PAM type: NRG; PAM sequence: GGG
gggtcgcccgccaggcctcg

SEQ ID NO: 9867 - DNA, 20 bp, Artificial Sequence
  Description of Artificial Sequence: Synthetic oligonucleotide
  Target: SOD1; (+) strand; PAM type: NRG; PAM sequence: TGG
gccaggcctcggggccgccc

SEQ ID NO: 9868 - DNA, 20 bp, Artificial Sequence
  Description of Artificial Sequence: Synthetic oligonucleotide
  Target: SOD1; (+) strand; PAM type: NRG; PAM sequence: CAG
gcctcggggccgccctggtc

SEQ ID NO: 9869 - DNA, 20 bp, Artificial Sequence
  Description of Artificial Sequence: Synthetic oligonucleotide
  Target: SOD1; (+) strand; PAM type: NRG; PAM sequence: CGG
ggccgccctggtccagcgcc

SEQ ID NO: 9870 - DNA, 20 bp, Artificial Sequence
  Description of Artificial Sequence: Synthetic oligonucleotide
  Target: SOD1; (+) strand; PAM type: NRG; PAM sequence: CGG
cctggtccagcgcccggtcc

SEQ ID NO: 9871 - DNA, 20 bp, Artificial Sequence
  Description of Artificial Sequence: Synthetic oligonucleotide
  Target: SOD1; (+) strand; PAM type: NRG; PAM sequence: CGG
cggtcccggcccgtgccgcc

SEQ ID NO: 9872 - DNA, 20 bp, Artificial Sequence
  Description of Artificial Sequence: Synthetic oligonucleotide
  Target: SOD1; (+) strand; PAM type: NRG; PAM sequence: CGG
cccggcccgtgccgcccggt

SEQ ID NO: 9873 - DNA, 20 bp, Artificial Sequence
  Description of Artificial Sequence: Synthetic oligonucleotide
  Target: SOD1; (+) strand; PAM type: NRG; PAM sequence: CAG
ccggtcggtgccttcgcccc

SEQ ID NO: 9874 - DNA, 20 bp, Artificial Sequence
  Description of Artificial Sequence: Synthetic oligonucleotide
  Target: SOD1; (+) strand; PAM type: NRG; PAM sequence: CGG
gtcggtgccttcgcccccag

SEQ ID NO: 9875 - DNA, 20 bp, Artificial Sequence
  Description of Artificial Sequence: Synthetic oligonucleotide
  Target: SOD1; (+) strand; PAM type: NRG; PAM sequence: CGG
tgccttcgcccccagcggtg

SEQ ID NO: 9876 - DNA, 20 bp, Artificial Sequence
  Description of Artificial Sequence: Synthetic oligonucleotide
  Target: SOD1; (+) strand; PAM type: NRG; PAM sequence: AAG
cccccagcggtgcggtgccc

SEQ ID NO: 9877 - DNA, 20 bp, Artificial Sequence
  Description of Artificial Sequence: Synthetic oligonucleotide
  Target: SOD1; (+) strand; PAM type: NRG; PAM sequence: GAG
cggtgcggtgcccaagtgct

SEQ ID NO: 9878 - DNA, 20 bp, Artificial Sequence
  Description of Artificial Sequence: Synthetic oligonucleotide
  Target: SOD1; (+) strand; PAM type: NRG; PAM sequence: CGG
gtgcccaagtgctgagtcac

SEQ ID NO: 9879 - DNA, 20 bp, Artificial Sequence
  Description of Artificial Sequence: Synthetic oligonucleotide
  Target: SOD1; (+) strand; PAM type: NRG; PAM sequence: GGG
tgcccaagtgctgagtcacc

SEQ ID NO: 9880 - DNA, 20 bp, Artificial Sequence
  Description of Artificial Sequence: Synthetic oligonucleotide
  Target: SOD1; (+) strand; PAM type: NRG; PAM sequence: CGG
ccaagtgctgagtcaccggg

SEQ ID NO: 9881 - DNA, 20 bp, Artificial Sequence
  Description of Artificial Sequence: Synthetic oligonucleotide
  Target: SOD1; (+) strand; PAM type: NRG; PAM sequence: GGG
caagtgctgagtcaccgggc

SEQ ID NO: 9882 - DNA, 20 bp, Artificial Sequence
  Description of Artificial Sequence: Synthetic oligonucleotide
  Target: SOD1; (+) strand; PAM type: NRG; PAM sequence: CGG
gctgagtcaccgggcgggcc

SEQ ID NO: 9883 - DNA, 20 bp, Artificial Sequence
  Description of Artificial Sequence: Synthetic oligonucleotide
  Target: SOD1; (+) strand; PAM type: NRG; PAM sequence: GGG
ctgagtcaccgggcgggccc

SEQ ID NO: 9884 - DNA, 20 bp, Artificial Sequence
  Description of Artificial Sequence: Synthetic oligonucleotide
  Target: SOD1; (+) strand; PAM type: NRG; PAM sequence: CGG
tcaccgggcgggcccgggcg

SEQ ID NO: 9885 - DNA, 20 bp, Artificial Sequence
  Description of Artificial Sequence: Synthetic oligonucleotide
  Target: SOD1; (+) strand; PAM type: NRG; PAM sequence: GGG
caccgggcgggcccgggcgc

SEQ ID NO: 9886 - DNA, 20 bp, Artificial Sequence
  Description of Artificial Sequence: Synthetic oligonucleotide
  Target: SOD1; (+) strand; PAM type: NRG; PAM sequence: GGG
accgggcgggcccgggcgcg

SEQ ID NO: 9887 - DNA, 20 bp, Artificial Sequence
  Description of Artificial Sequence: Synthetic oligonucleotide
  Target: SOD1; (+) strand; PAM type: NRG; PAM sequence: TGG
gcgggcccgggcgcggggcg

SEQ ID NO: 9888 - DNA, 20 bp, Artificial Sequence
  Description of Artificial Sequence: Synthetic oligonucleotide
  Target: SOD1; (+) strand; PAM type: NRG; PAM sequence: GGG
cgggcccgggcgcggggcgt

SEQ ID NO: 9889 - DNA, 20 bp, Artificial Sequence
  Description of Artificial Sequence: Synthetic oligonucleotide
  Target: SOD1; (+) strand; PAM type: NRG; PAM sequence: GAG
cgggcgcggggcgtgggacc

SEQ ID NO: 9890 - DNA, 20 bp, Artificial Sequence
  Description of Artificial Sequence: Synthetic oligonucleotide
  Target: SOD1; (+) strand; PAM type: NRG; PAM sequence: AGG
gggcgcggggcgtgggaccg

SEQ ID NO: 9891 - DNA, 20 bp, Artificial Sequence
  Description of Artificial Sequence: Synthetic oligonucleotide
  Target: SOD1; (+) strand; PAM type: NRG; PAM sequence: CGG
gcgtgggaccgaggccgccg

SEQ ID NO: 9892 - DNA, 20 bp, Artificial Sequence
  Description of Artificial Sequence: Synthetic oligonucleotide
  Target: SOD1; (+) strand; PAM type: NRG; PAM sequence: GGG
cgtgggaccgaggccgccgc

SEQ ID NO: 9893 - DNA, 20 bp, Artificial Sequence
  Description of Artificial Sequence: Synthetic oligonucleotide
  Target: SOD1; (+) strand; PAM type: NRG; PAM sequence: GGG
gtgggaccgaggccgccgcg

SEQ ID NO: 9894 - DNA, 20 bp, Artificial Sequence
  Description of Artificial Sequence: Synthetic oligonucleotide
  Target: SOD1; (+) strand; PAM type: NRG; PAM sequence: TGG
gaccgaggccgccgcggggc

SEQ ID NO: 9895 - DNA, 20 bp, Artificial Sequence
  Description of Artificial Sequence: Synthetic oligonucleotide
  Target: SOD1; (+) strand; PAM type: NRG; PAM sequence: GGG
accgaggccgccgcggggct

SEQ ID NO: 9896 - DNA, 20 bp, Artificial Sequence
  Description of Artificial Sequence: Synthetic oligonucleotide
  Target: SOD1; (+) strand; PAM type: NRG; PAM sequence: TGG
cgcggggctgggcctgcgcg

SEQ ID NO: 9897 - DNA, 20 bp, Artificial Sequence
  Description of Artificial Sequence: Synthetic oligonucleotide
  Target: SOD1; (+) strand; PAM type: NRG; PAM sequence: CGG
ggggctgggcctgcgcgtgg

SEQ ID NO: 9898 - DNA, 20 bp, Artificial Sequence
  Description of Artificial Sequence: Synthetic oligonucleotide
  Target: SOD1; (+) strand; PAM type: NRG; PAM sequence: GGG
gggctgggcctgcgcgtggc

SEQ ID NO: 9899 - DNA, 20 bp, Artificial Sequence
  Description of Artificial Sequence: Synthetic oligonucleotide
  Target: SOD1; (+) strand; PAM type: NRG; PAM sequence: GAG
gctgggcctgcgcgtggcgg

SEQ ID NO: 9900 - DNA, 20 bp, Artificial Sequence
  Description of Artificial Sequence: Synthetic oligonucleotide
  Target: SOD1; (+) strand; PAM type: NRG; PAM sequence: CGG
gcctgcgcgtggcgggagcg

SEQ ID NO: 9901 - DNA, 20 bp, Artificial Sequence
  Description of Artificial Sequence: Synthetic oligonucleotide
  Target: SOD1; (+) strand; PAM type: NRG; PAM sequence: GGG
cctgcgcgtggcgggagcgc

SEQ ID NO: 9902 - DNA, 20 bp, Artificial Sequence
  Description of Artificial Sequence: Synthetic oligonucleotide
  Target: SOD1; (+) strand; PAM type: NRG; PAM sequence: GGG
ctgcgcgtggcgggagcgcg

SEQ ID NO: 9903 - DNA, 20 bp, Artificial Sequence
  Description of Artificial Sequence: Synthetic oligonucleotide
  Target: SOD1; (+) strand; PAM type: NRG; PAM sequence: GAG
gcgcgtggcgggagcgcggg

SEQ ID NO: 9904 - DNA, 20 bp, Artificial Sequence
  Description of Artificial Sequence: Synthetic oligonucleotide
  Target: SOD1; (+) strand; PAM type: NRG; PAM sequence: AGG
cgcgtggcgggagcgcgggg

SEQ ID NO: 9905 - DNA, 20 bp, Artificial Sequence
  Description of Artificial Sequence: Synthetic oligonucleotide
  Target: SOD1; (+) strand; PAM type: NRG; PAM sequence: GGG
gcgtggcgggagcgcgggga

SEQ ID NO: 9906 - DNA, 20 bp, Artificial Sequence
  Description of Artificial Sequence: Synthetic oligonucleotide
  Target: SOD1; (+) strand; PAM type: NRG; PAM sequence: CGG
agcgcggggagggattgccg

SEQ ID NO: 9907 - DNA, 20 bp, Artificial Sequence
  Description of Artificial Sequence: Synthetic oligonucleotide
  Target: SOD1; (+) strand; PAM type: NRG; PAM sequence: GGG
gcgcggggagggattgccgc

SEQ ID NO: 9908 - DNA, 20 bp, Artificial Sequence
  Description of Artificial Sequence: Synthetic oligonucleotide
  Target: SOD1; (+) strand; PAM type: NRG; PAM sequence: CGG
ggggagggattgccgcgggc

SEQ ID NO: 9909 - DNA, 20 bp, Artificial Sequence
  Description of Artificial Sequence: Synthetic oligonucleotide
  Target: SOD1; (+) strand; PAM type: NRG; PAM sequence: GGG
gggagggattgccgcgggcc

SEQ ID NO: 9910 - DNA, 20 bp, Artificial Sequence
  Description of Artificial Sequence: Synthetic oligonucleotide
  Target: SOD1; (+) strand; PAM type: NRG; PAM sequence: GGG
ggagggattgccgcgggccg

SEQ ID NO: 9911 - DNA, 20 bp, Artificial Sequence
  Description of Artificial Sequence: Synthetic oligonucleotide
  Target: SOD1; (+) strand; PAM type: NRG; PAM sequence: GAG
agggattgccgcgggccggg

SEQ ID NO: 9912 - DNA, 20 bp, Artificial Sequence
  Description of Artificial Sequence: Synthetic oligonucleotide
  Target: SOD1; (+) strand; PAM type: NRG; PAM sequence: AGG
gggattgccgcgggccgggg

SEQ ID NO: 9913 - DNA, 20 bp, Artificial Sequence
  Description of Artificial Sequence: Synthetic oligonucleotide
  Target: SOD1; (+) strand; PAM type: NRG; PAM sequence: GGG
ggattgccgcgggccgggga

SEQ ID NO: 9914 - DNA, 20 bp, Artificial Sequence
  Description of Artificial Sequence: Synthetic oligonucleotide
  Target: SOD1; (+) strand; PAM type: NRG; PAM sequence: GGG
gattgccgcgggccggggag

SEQ ID NO: 9915 - DNA, 20 bp, Artificial Sequence
  Description of Artificial Sequence: Synthetic oligonucleotide
  Target: SOD1; (+) strand; PAM type: NRG; PAM sequence: CGG
tgccgcgggccggggagggg

SEQ ID NO: 9916 - DNA, 20 bp, Artificial Sequence
  Description of Artificial Sequence: Synthetic oligonucleotide
  Target: SOD1; (+) strand; PAM type: NRG; PAM sequence: GGG
gccgcgggccggggaggggc

SEQ ID NO: 9917 - DNA, 20 bp, Artificial Sequence
  Description of Artificial Sequence: Synthetic oligonucleotide
  Target: SOD1; (+) strand; PAM type: NRG; PAM sequence: GGG
ccgcgggccggggaggggcg

SEQ ID NO: 9918 - DNA, 20 bp, Artificial Sequence
  Description of Artificial Sequence: Synthetic oligonucleotide
  Target: SOD1; (+) strand; PAM type: NRG; PAM sequence: GGG
cgcgggccggggaggggcgg

SEQ ID NO: 9919 - DNA, 20 bp, Artificial Sequence
  Description of Artificial Sequence: Synthetic oligonucleotide
  Target: SOD1; (+) strand; PAM type: NRG; PAM sequence: CGG
gggccggggaggggcggggg

SEQ ID NO: 9920 - DNA, 20 bp, Artificial Sequence
  Description of Artificial Sequence: Synthetic oligonucleotide
  Target: SOD1; (+) strand; PAM type: NRG; PAM sequence: GGG
ggccggggaggggcgggggc

SEQ ID NO: 9921 - DNA, 20 bp, Artificial Sequence
  Description of Artificial Sequence: Synthetic oligonucleotide
  Target: SOD1; (+) strand; PAM type: NRG; PAM sequence: TGG
ggcgggcgtgctgccctctg

SEQ ID NO: 9922 - DNA, 20 bp, Artificial Sequence
  Description of Artificial Sequence: Synthetic oligonucleotide
  Target: SOD1; (+) strand; PAM type: NRG; PAM sequence: TGG
gtgctgccctctgtggtcct

SEQ ID NO: 9923 - DNA, 20 bp, Artificial Sequence
  Description of Artificial Sequence: Synthetic oligonucleotide
  Target: SOD1; (+) strand; PAM type: NRG; PAM sequence: GGG
tgctgccctctgtggtcctt

SEQ ID NO: 9924 - DNA, 20 bp, Artificial Sequence
  Description of Artificial Sequence: Synthetic oligonucleotide
  Target: SOD1; (+) strand; PAM type: NRG; PAM sequence: CGG
tggtccttgggccgccgccg

SEQ ID NO: 9925 - DNA, 20 bp, Artificial Sequence
  Description of Artificial Sequence: Synthetic oligonucleotide
  Target: SOD1; (+) strand; PAM type: NRG; PAM sequence: GGG
ggtccttgggccgccgccgc

SEQ ID NO: 9926 - DNA, 20 bp, Artificial Sequence
  Description of Artificial Sequence: Synthetic oligonucleotide
  Target: SOD1; (+) strand; PAM type: NRG; PAM sequence: TGG
ccgccgccgcgggtctgtcg

SEQ ID NO: 9927 - DNA, 20 bp, Artificial Sequence
  Description of Artificial Sequence: Synthetic oligonucleotide
  Target: SOD1; (+) strand; PAM type: NRG; PAM sequence: TGG
cgcgggtctgtcgtggtgcc

SEQ ID NO: 9928 - DNA, 20 bp, Artificial Sequence
  Description of Artificial Sequence: Synthetic oligonucleotide
  Target: SOD1; (+) strand; PAM type: NRG; PAM sequence: GAG
cgggtctgtcgtggtgcctg

SEQ ID NO: 9929 - DNA, 20 bp, Artificial Sequence
  Description of Artificial Sequence: Synthetic oligonucleotide
  Target: SOD1; (+) strand; PAM type: NRG; PAM sequence: CGG
gtctgtcgtggtgcctggag

SEQ ID NO: 9930 - DNA, 20 bp, Artificial Sequence
  Description of Artificial Sequence: Synthetic oligonucleotide
  Target: SOD1; (+) strand; PAM type: NRG; PAM sequence: TGG
ggctgtgctcgtcccttgct

SEQ ID NO: 9931 - DNA, 20 bp, Artificial Sequence
  Description of Artificial Sequence: Synthetic oligonucleotide
  Target: SOD1; (+) strand; PAM type: NRG; PAM sequence: GAG
ttggccgtgttctcgttcct

SEQ ID NO: 9932 - DNA, 20 bp, Artificial Sequence
  Description of Artificial Sequence: Synthetic oligonucleotide
  Target: SOD1; (+) strand; PAM type: NRG; PAM sequence: AGG
tggccgtgttctcgttcctg

SEQ ID NO: 9933 - DNA, 20 bp, Artificial Sequence
  Description of Artificial Sequence: Synthetic oligonucleotide
  Target: SOD1; (+) strand; PAM type: NRG; PAM sequence: GGG
ggccgtgttctcgttcctga

SEQ ID NO: 9934 - DNA, 20 bp, Artificial Sequence
  Description of Artificial Sequence: Synthetic oligonucleotide
  Target: SOD1; (+) strand; PAM type: NRG; PAM sequence: CGG
tctcgttcctgagggtcccg

SEQ ID NO: 9935 - DNA, 20 bp, Artificial Sequence
  Description of Artificial Sequence: Synthetic oligonucleotide
  Target: SOD1; (+) strand; PAM type: NRG; PAM sequence: GAG
ctgagggtcccgcggacacc

SEQ ID NO: 9936 - DNA, 20 bp, Artificial Sequence
  Description of Artificial Sequence: Synthetic oligonucleotide
  Target: SOD1; (+) strand; PAM type: NRG; PAM sequence: TGG
agggtcccgcggacaccgag

SEQ ID NO: 9937 - DNA, 20 bp, Artificial Sequence
  Description of Artificial Sequence: Synthetic oligonucleotide
  Target: SOD1; (+) strand; PAM type: NRG; PAM sequence: CAG
cccgcggacaccgagtggcg

SEQ ID NO: 9938 - DNA, 20 bp, Artificial Sequence
  Description of Artificial Sequence: Synthetic oligonucleotide
  Target: SOD1; (+) strand; PAM type: NRG; PAM sequence: CAG
gacaccgagtggcgcagtgc

SEQ ID NO: 9939 - DNA, 20 bp, Artificial Sequence
  Description of Artificial Sequence: Synthetic oligonucleotide
  Target: SOD1; (+) strand; PAM type: NRG; PAM sequence: AGG
acaccgagtggcgcagtgcc

SEQ ID NO: 9940 - DNA, 20 bp, Artificial Sequence
  Description of Artificial Sequence: Synthetic oligonucleotide
  Target: SOD1; (+) strand; PAM type: NRG; PAM sequence: CAG
gagtggcgcagtgccaggcc

SEQ ID NO: 9941 - DNA, 20 bp, Artificial Sequence
  Description of Artificial Sequence: Synthetic oligonucleotide
  Target: SOD1; (+) strand; PAM type: NRG; PAM sequence: CGG
gcgcagtgccaggcccagcc

SEQ ID NO: 9942 - DNA, 20 bp, Artificial Sequence
  Description of Artificial Sequence: Synthetic oligonucleotide
  Target: SOD1; (+) strand; PAM type: NRG; PAM sequence: GGG
cgcagtgccaggcccagccc

SEQ ID NO: 9943 - DNA, 20 bp, Artificial Sequence
  Description of Artificial Sequence: Synthetic oligonucleotide
  Target: SOD1; (+) strand; PAM type: NRG; PAM sequence: GGG
gcagtgccaggcccagcccg

SEQ ID NO: 9944 - DNA, 20 bp, Artificial Sequence
  Description of Artificial Sequence: Synthetic oligonucleotide
  Target: SOD1; (+) strand; PAM type: NRG; PAM sequence: TGG
tgccaggcccagcccgggga

SEQ ID NO: 9945 - DNA, 20 bp, Artificial Sequence
  Description of Artificial Sequence: Synthetic oligonucleotide
  Target: SOD1; (+) strand; PAM type: NRG; PAM sequence: TGG
ccggggatggcgactgcgcc

SEQ ID NO: 9946 - DNA, 20 bp, Artificial Sequence
  Description of Artificial Sequence: Synthetic oligonucleotide
  Target: SOD1; (+) strand; PAM type: NRG; PAM sequence: GGG
cggggatggcgactgcgcct

SEQ ID NO: 9947 - DNA, 20 bp, Artificial Sequence
  Description of Artificial Sequence: Synthetic oligonucleotide
  Target: SOD1; (+) strand; PAM type: NRG; PAM sequence: TGG
cgactgcgcctgggcccgcc

SEQ ID NO: 9948 - DNA, 20 bp, Artificial Sequence
  Description of Artificial Sequence: Synthetic oligonucleotide
  Target: SOD1; (+) strand; PAM type: NRG; PAM sequence: CGG
tcgcatccctctccgctttc

SEQ ID NO: 9949 - DNA, 20 bp, Artificial Sequence
  Description of Artificial Sequence: Synthetic oligonucleotide
  Target: SOD1; (+) strand; PAM type: NRG; PAM sequence: CAG
ccctctccgctttccggctt

SEQ ID NO: 9950 - DNA, 20 bp, Artificial Sequence
  Description of Artificial Sequence: Synthetic oligonucleotide
  Target: SOD1; (+) strand; PAM type: NRG; PAM sequence: TAG
gctttccggcttcagcgctc

SEQ ID NO: 9951 - DNA, 20 bp, Artificial Sequence
  Description of Artificial Sequence: Synthetic oligonucleotide
  Target: SOD1; (+) strand; PAM type: NRG; PAM sequence: AGG
ctttccggcttcagcgctct

SEQ ID NO: 9952 - DNA, 20 bp, Artificial Sequence
  Description of Artificial Sequence: Synthetic oligonucleotide
  Target: SOD1; (+) strand; PAM type: NRG; PAM sequence: CAG
ccggcttcagcgctctaggt

SEQ ID NO: 9953 - DNA, 20 bp, Artificial Sequence
  Description of Artificial Sequence: Synthetic oligonucleotide
  Target: SOD1; (+) strand; PAM type: NRG; PAM sequence: AGG
cggcttcagcgctctaggtc

SEQ ID NO: 9954 - DNA, 20 bp, Artificial Sequence
  Description of Artificial Sequence: Synthetic oligonucleotide
  Target: SOD1; (+) strand; PAM type: NRG; PAM sequence: GGG
ggcttcagcgctctaggtca

SEQ ID NO: 9955 - DNA, 20 bp, Artificial Sequence
  Description of Artificial Sequence: Synthetic oligonucleotide
  Target: SOD1; (+) strand; PAM type: NRG; PAM sequence: GAG
cttcagcgctctaggtcagg

SEQ ID NO: 9956 - DNA, 20 bp, Artificial Sequence
  Description of Artificial Sequence: Synthetic oligonucleotide
  Target: SOD1; (+) strand; PAM type: NRG; PAM sequence: CAG
agggagtcttcgcttttgta

SEQ ID NO: 9957 - DNA, 20 bp, Artificial Sequence
  Description of Artificial Sequence: Synthetic oligonucleotide
  Target: SOD1; (+) strand; PAM type: NRG; PAM sequence: AAG
cttcgcttttgtacagctct

SEQ ID NO: 9958 - DNA, 20 bp, Artificial Sequence
  Description of Artificial Sequence: Synthetic oligonucleotide
  Target: SOD1; (+) strand; PAM type: NRG; PAM sequence: AGG
ttcgcttttgtacagctcta

SEQ ID NO: 9959 - DNA, 20 bp, Artificial Sequence
  Description of Artificial Sequence: Synthetic oligonucleotide
  Target: SOD1; (+) strand; PAM type: NRG; PAM sequence: TAG
cttttgtacagctctaaggc

SEQ ID NO: 9960 - DNA, 20 bp, Artificial Sequence
  Description of Artificial Sequence: Synthetic oligonucleotide
  Target: SOD1; (+) strand; PAM type: NRG; PAM sequence: AGG
ttttgtacagctctaaggct

SEQ ID NO: 9961 - DNA, 20 bp, Artificial Sequence
  Description of Artificial Sequence: Synthetic oligonucleotide
  Target: SOD1; (+) strand; PAM type: NRG; PAM sequence: TGG
tacagctctaaggctaggaa

SEQ ID NO: 9962 - DNA, 20 bp, Artificial Sequence
  Description of Artificial Sequence: Synthetic oligonucleotide
  Target: SOD1; (+) strand; PAM type: NRG; PAM sequence: AAG
aatggtttttatatttttaa

SEQ ID NO: 9963 - DNA, 20 bp, Artificial Sequence
  Description of Artificial Sequence: Synthetic oligonucleotide
  Target: SOD1; (+) strand; PAM type: NRG; PAM sequence: AGG
atggtttttatatttttaaa

SEQ ID NO: 9964 - DNA, 20 bp, Artificial Sequence
  Description of Artificial Sequence: Synthetic oligonucleotide
  Target: SOD1; (+) strand; PAM type: NRG; PAM sequence: TGG
tttatatttttaaaaggctt

SEQ ID NO: 9965 - DNA, 20 bp, Artificial Sequence
  Description of Artificial Sequence: Synthetic oligonucleotide
  Target: SOD1; (+) strand; PAM type: NRG; PAM sequence: CAG
tggaaaacaaaaatacgcaa

SEQ ID NO: 9966 - DNA, 20 bp, Artificial Sequence
  Description of Artificial Sequence: Synthetic oligonucleotide
  Target: SOD1; (+) strand; PAM type: NRG; PAM sequence: GAG
gaaaacaaaaatacgcaaca

SEQ ID NO: 9967 - DNA, 20 bp, Artificial Sequence
  Description of Artificial Sequence: Synthetic oligonucleotide
  Target: SOD1; (+) strand; PAM type: NRG; PAM sequence: CAG
accgtttgtgtgacactttg

SEQ ID NO: 9968 - DNA, 20 bp, Artificial Sequence
  Description of Artificial Sequence: Synthetic oligonucleotide
  Target: SOD1; (+) strand; PAM type: NRG; PAM sequence: AGG
ccgtttgtgtgacactttgc

SEQ ID NO: 9969 - DNA, 20 bp, Artificial Sequence
  Description of Artificial Sequence: Synthetic oligonucleotide
  Target: SOD1; (+) strand; PAM type: NRG; PAM sequence: GGG
cgtttgtgtgacactttgca

SEQ ID NO: 9970 - DNA, 20 bp, Artificial Sequence
  Description of Artificial Sequence: Synthetic oligonucleotide
  Target: SOD1; (+) strand; PAM type: NRG; PAM sequence: AAG
ttgtgtgacactttgcaggg

SEQ ID NO: 9971 - DNA, 20 bp, Artificial Sequence
  Description of Artificial Sequence: Synthetic oligonucleotide
  Target: SOD1; (+) strand; PAM type: NRG; PAM sequence: TGG
cactttgcagggaagtttgc

SEQ ID NO: 9972 - DNA, 20 bp, Artificial Sequence
  Description of Artificial Sequence: Synthetic oligonucleotide
  Target: SOD1; (+) strand; PAM type: NRG; PAM sequence: TAG
aagtttgctggcctctgttc

SEQ ID NO: 9973 - DNA, 20 bp, Artificial Sequence
  Description of Artificial Sequence: Synthetic oligonucleotide
  Target: SOD1; (+) strand; PAM type: NRG; PAM sequence: AGG
agtttgctggcctctgttct

SEQ ID NO: 9974 - DNA, 20 bp, Artificial Sequence
  Description of Artificial Sequence: Synthetic oligonucleotide
  Target: SOD1; (+) strand; PAM type: NRG; PAM sequence: TGG
cctctgttctaggtcatgat

SEQ ID NO: 9975 - DNA, 20 bp, Artificial Sequence
  Description of Artificial Sequence: Synthetic oligonucleotide
  Target: SOD1; (+) strand; PAM type: NRG; PAM sequence: GGG
ctctgttctaggtcatgatt

SEQ ID NO: 9976 - DNA, 20 bp, Artificial Sequence
  Description of Artificial Sequence: Synthetic oligonucleotide
  Target: SOD1; (+) strand; PAM type: NRG; PAM sequence: AAG
ctaggtcatgattgggctgc

SEQ ID NO: 9977 - DNA, 20 bp, Artificial Sequence
  Description of Artificial Sequence: Synthetic oligonucleotide
  Target: SOD1; (+) strand; PAM type: NRG; PAM sequence: AGG
taggtcatgattgggctgca

SEQ ID NO: 9978 - DNA, 20 bp, Artificial Sequence
  Description of Artificial Sequence: Synthetic oligonucleotide
  Target: SOD1; (+) strand; PAM type: NRG; PAM sequence: GGG
aggtcatgattgggctgcaa

SEQ ID NO: 9979 - DNA, 20 bp, Artificial Sequence
  Description of Artificial Sequence: Synthetic oligonucleotide
  Target: SOD1; (+) strand; PAM type: NRG; PAM sequence: CAG
tcatgattgggctgcaaggg

SEQ ID NO: 9980 - DNA, 20 bp, Artificial Sequence
  Description of Artificial Sequence: Synthetic oligonucleotide
  Target: SOD1; (+) strand; PAM type: NRG; PAM sequence: GAG
atgattgggctgcaagggca

SEQ ID NO: 9981 - DNA, 20 bp, Artificial Sequence
  Description of Artificial Sequence: Synthetic oligonucleotide
  Target: SOD1; (+) strand; PAM type: NRG; PAM sequence: AAG
attgggctgcaagggcagag

SEQ ID NO: 9982 - DNA, 20 bp, Artificial Sequence
  Description of Artificial Sequence: Synthetic oligonucleotide
  Target: SOD1; (+) strand; PAM type: NRG; PAM sequence: AGG
ttgggctgcaagggcagaga

SEQ ID NO: 9983 - DNA, 20 bp, Artificial Sequence
  Description of Artificial Sequence: Synthetic oligonucleotide
  Target: SOD1; (+) strand; PAM type: NRG; PAM sequence: TAG
ggctgcaagggcagagaagg

SEQ ID NO: 9984 - DNA, 20 bp, Artificial Sequence
  Description of Artificial Sequence: Synthetic oligonucleotide
  Target: SOD1; (+) strand; PAM type: NRG; PAM sequence: CAG
gcagagaaggtagccttgaa

SEQ ID NO: 9985 - DNA, 20 bp, Artificial Sequence
  Description of Artificial Sequence: Synthetic oligonucleotide
  Target: SOD1; (+) strand; PAM type: NRG; PAM sequence: GAG
agagaaggtagccttgaaca

SEQ ID NO: 9986 - DNA, 20 bp, Artificial Sequence
  Description of Artificial Sequence: Synthetic oligonucleotide
  Target: SOD1; (+) strand; PAM type: NRG; PAM sequence: AGG
gagaaggtagccttgaacag

SEQ ID NO: 9987 - DNA, 20 bp, Artificial Sequence
  Description of Artificial Sequence: Synthetic oligonucleotide
  Target: SOD1; (+) strand; PAM type: NRG; PAM sequence: AAG
gaggtccttttcctcctcct

SEQ ID NO: 9988 - DNA, 20 bp, Artificial Sequence
  Description of Artificial Sequence: Synthetic oligonucleotide
  Target: SOD1; (+) strand; PAM type: NRG; PAM sequence: CGG
cttttcctcctcctaagctc

SEQ ID NO: 9989 - DNA, 20 bp, Artificial Sequence
  Description of Artificial Sequence: Synthetic oligonucleotide
  Target: SOD1; (+) strand; PAM type: NRG; PAM sequence: GGG
ttttcctcctcctaagctcc

SEQ ID NO: 9990 - DNA, 20 bp, Artificial Sequence
  Description of Artificial Sequence: Synthetic oligonucleotide
  Target: SOD1; (+) strand; PAM type: NRG; PAM sequence: GAG
ttcctcctcctaagctccgg

SEQ ID NO: 9991 - DNA, 20 bp, Artificial Sequence
  Description of Artificial Sequence: Synthetic oligonucleotide
  Target: SOD1; (+) strand; PAM type: NRG; PAM sequence: CAG
tcctcctaagctccgggagc

SEQ ID NO: 9992 - DNA, 20 bp, Artificial Sequence
  Description of Artificial Sequence: Synthetic oligonucleotide
  Target: SOD1; (+) strand; PAM type: NRG; PAM sequence: GAG
ctcctaagctccgggagcca

SEQ ID NO: 9993 - DNA, 20 bp, Artificial Sequence
  Description of Artificial Sequence: Synthetic oligonucleotide
  Target: SOD1; (+) strand; PAM type: NRG; PAM sequence: AGG
tcctaagctccgggagccag

SEQ ID NO: 9994 - DNA, 20 bp, Artificial Sequence
  Description of Artificial Sequence: Synthetic oligonucleotide
  Target: SOD1; (+) strand; PAM type: NRG; PAM sequence: TGG
agaggtttaactgacccttt

SEQ ID NO: 9995 - DNA, 20 bp, Artificial Sequence
  Description of Artificial Sequence: Synthetic oligonucleotide
  Target: SOD1; (+) strand; PAM type: NRG; PAM sequence: GGG
gaggtttaactgaccctttt

SEQ ID NO: 9996 - DNA, 20 bp, Artificial Sequence
  Description of Artificial Sequence: Synthetic oligonucleotide
  Target: SOD1; (+) strand; PAM type: NRG; PAM sequence: GGG
aggtttaactgacccttttg

SEQ ID NO: 9997 - DNA, 20 bp, Artificial Sequence
  Description of Artificial Sequence: Synthetic oligonucleotide
  Target: SOD1; (+) strand; PAM type: NRG; PAM sequence: GAG
tgacccttttggggattttt

SEQ ID NO: 9998 - DNA, 20 bp, Artificial Sequence
  Description of Artificial Sequence: Synthetic oligonucleotide
  Target: SOD1; (+) strand; PAM type: NRG; PAM sequence: AGG
gacccttttggggatttttg

SEQ ID NO: 9999 - DNA, 20 bp, Artificial Sequence
  Description of Artificial Sequence: Synthetic oligonucleotide
  Target: SOD1; (+) strand; PAM type: NRG; PAM sequence: GGG
acccttttggggatttttga

SEQ ID NO: 10000 - DNA, 20 bp, Artificial Sequence
  Description of Artificial Sequence: Synthetic oligonucleotide
  Target: SOD1; (+) strand; PAM type: NRG; PAM sequence: CAG
cttttggggatttttgaggg

SEQ ID NO: 10001 - DNA, 20 bp, Artificial Sequence
  Description of Artificial Sequence: Synthetic oligonucleotide
  Target: SOD1; (+) strand; PAM type: NRG; PAM sequence: TGG
gagggcagtgatcttaactt

SEQ ID NO: 10002 - DNA, 20 bp, Artificial Sequence
  Description of Artificial Sequence: Synthetic oligonucleotide
  Target: SOD1; (+) strand; PAM type: NRG; PAM sequence: GGG
agggcagtgatcttaacttt

SEQ ID NO: 10003 - DNA, 20 bp, Artificial Sequence
  Description of Artificial Sequence: Synthetic oligonucleotide
  Target: SOD1; (+) strand; PAM type: NRG; PAM sequence: CAG
tgatcttaactttgggtgca

SEQ ID NO: 10004 - DNA, 20 bp, Artificial Sequence
  Description of Artificial Sequence: Synthetic oligonucleotide
  Target: SOD1; (+) strand; PAM type: NRG; PAM sequence: TAG
cttaactttgggtgcacagt

SEQ ID NO: 10005 - DNA, 20 bp, Artificial Sequence
  Description of Artificial Sequence: Synthetic oligonucleotide
  Target: SOD1; (+) strand; PAM type: NRG; PAM sequence: AAG
gtgcacagttagcttatttg

SEQ ID NO: 10006 - DNA, 20 bp, Artificial Sequence
  Description of Artificial Sequence: Synthetic oligonucleotide
  Target: SOD1; (+) strand; PAM type: NRG; PAM sequence: CAG
agatcttactaaaaatacac

SEQ ID NO: 10007 - DNA, 20 bp, Artificial Sequence
  Description of Artificial Sequence: Synthetic oligonucleotide
  Target: SOD1; (+) strand; PAM type: NRG; PAM sequence: GAG
atcttactaaaaatacacca

SEQ ID NO: 10008 - DNA, 20 bp, Artificial Sequence
  Description of Artificial Sequence: Synthetic oligonucleotide
  Target: SOD1; (+) strand; PAM type: NRG; PAM sequence: TAG
aattacatcaaaacctgtcc

SEQ ID NO: 10009 - DNA, 20 bp, Artificial Sequence
  Description of Artificial Sequence: Synthetic oligonucleotide
  Target: SOD1; (+) strand; PAM type: NRG; PAM sequence: CAG
catcaaaacctgtcctagtg

SEQ ID NO: 10010 - DNA, 20 bp, Artificial Sequence
  Description of Artificial Sequence: Synthetic oligonucleotide
  Target: SOD1; (+) strand; PAM type: NRG; PAM sequence: AGG
atcaaaacctgtcctagtgc

SEQ ID NO: 10011 - DNA, 20 bp, Artificial Sequence
  Description of Artificial Sequence: Synthetic oligonucleotide
  Target: SOD1; (+) strand; PAM type: NRG; PAM sequence: GGG
tcaaaacctgtcctagtgca

SEQ ID NO: 10012 - DNA, 20 bp, Artificial Sequence
  Description of Artificial Sequence: Synthetic oligonucleotide
  Target: SOD1; (+) strand; PAM type: NRG; PAM sequence: GAG
aacctgtcctagtgcagggt

SEQ ID NO: 10013 - DNA, 20 bp, Artificial Sequence
  Description of Artificial Sequence: Synthetic oligonucleotide
  Target: SOD1; (+) strand; PAM type: NRG; PAM sequence: AAG
tgagtattgctgttttttga

SEQ ID NO: 10014 - DNA, 20 bp, Artificial Sequence
  Description of Artificial Sequence: Synthetic oligonucleotide
  Target: SOD1; (+) strand; PAM type: NRG; PAM sequence: AAG
tgttttttgaaagtttccaa

SEQ ID NO: 10015 - DNA, 20 bp, Artificial Sequence
  Description of Artificial Sequence: Synthetic oligonucleotide
  Target: SOD1; (+) strand; PAM type: NRG; PAM sequence: GAG
tttgatgtgcacctacgatt

SEQ ID NO: 10016 - DNA, 20 bp, Artificial Sequence
  Description of Artificial Sequence: Synthetic oligonucleotide
  Target: SOD1; (+) strand; PAM type: NRG; PAM sequence: GAG
acgattgagaactgtcgttt

SEQ ID NO: 10017 - DNA, 20 bp, Artificial Sequence
  Description of Artificial Sequence: Synthetic oligonucleotide
  Target: SOD1; (+) strand; PAM type: NRG; PAM sequence: AGG
cgattgagaactgtcgtttg

SEQ ID NO: 10018 - DNA, 20 bp, Artificial Sequence
  Description of Artificial Sequence: Synthetic oligonucleotide
  Target: SOD1; (+) strand; PAM type: NRG; PAM sequence: CAG
tgagaactgtcgtttgagga

SEQ ID NO: 10019 - DNA, 20 bp, Artificial Sequence
  Description of Artificial Sequence: Synthetic oligonucleotide
  Target: SOD1; (+) strand; PAM type: NRG; PAM sequence: TGG
gaactgtcgtttgaggacag

SEQ ID NO: 10020 - DNA, 20 bp, Artificial Sequence
  Description of Artificial Sequence: Synthetic oligonucleotide
  Target: SOD1; (+) strand; PAM type: NRG; PAM sequence: GGG
aactgtcgtttgaggacagt

SEQ ID NO: 10021 - DNA, 20 bp, Artificial Sequence
  Description of Artificial Sequence: Synthetic oligonucleotide
  Target: SOD1; (+) strand; PAM type: NRG; PAM sequence: TGG
tgtcgtttgaggacagtggg

SEQ ID NO: 10022 - DNA, 20 bp, Artificial Sequence
  Description of Artificial Sequence: Synthetic oligonucleotide
  Target: SOD1; (+) strand; PAM type: NRG; PAM sequence: GAG
tcgtttgaggacagtgggtg

SEQ ID NO: 10023 - DNA, 20 bp, Artificial Sequence
  Description of Artificial Sequence: Synthetic oligonucleotide
  Target: SOD1; (+) strand; PAM type: NRG; PAM sequence: TGG
agtgggtggagtttcgtatt

SEQ ID NO: 10024 - DNA, 20 bp, Artificial Sequence
  Description of Artificial Sequence: Synthetic oligonucleotide
  Target: SOD1; (+) strand; PAM type: NRG; PAM sequence: TAG
ggagtttcgtatttggaaat

SEQ ID NO: 10025 - DNA, 20 bp, Artificial Sequence
  Description of Artificial Sequence: Synthetic oligonucleotide
  Target: SOD1; (+) strand; PAM type: NRG; PAM sequence: AAG
gtttcgtatttggaaattag

SEQ ID NO: 10026 - DNA, 20 bp, Artificial Sequence
  Description of Artificial Sequence: Synthetic oligonucleotide
  Target: SOD1; (+) strand; PAM type: NRG; PAM sequence: TGG
tatttggaaattagaagacc

SEQ ID NO: 10027 - DNA, 20 bp, Artificial Sequence
  Description of Artificial Sequence: Synthetic oligonucleotide
  Target: SOD1; (+) strand; PAM type: NRG; PAM sequence: GAG
tttggaaattagaagacctg

SEQ ID NO: 10028 - DNA, 20 bp, Artificial Sequence
  Description of Artificial Sequence: Synthetic oligonucleotide
  Target: SOD1; (+) strand; PAM type: NRG; PAM sequence: TGG
gagtttccattacaccgaat

SEQ ID NO: 10029 - DNA, 20 bp, Artificial Sequence
  Description of Artificial Sequence: Synthetic oligonucleotide
  Target: SOD1; (+) strand; PAM type: NRG; PAM sequence: CGG
tggcacttaataactgttgt

SEQ ID NO: 10030 - DNA, 20 bp, Artificial Sequence
  Description of Artificial Sequence: Synthetic oligonucleotide
  Target: SOD1; (+) strand; PAM type: NRG; PAM sequence: GAG
gcacttaataactgttgtcg

SEQ ID NO: 10031 - DNA, 20 bp, Artificial Sequence
  Description of Artificial Sequence: Synthetic oligonucleotide
  Target: SOD1; (+) strand; PAM type: NRG; PAM sequence: AAG
ctgttgtcggagcatttctt

SEQ ID NO: 10032 - DNA, 20 bp, Artificial Sequence
  Description of Artificial Sequence: Synthetic oligonucleotide
  Target: SOD1; (+) strand; PAM type: NRG; PAM sequence: AAG
tcttaagccacattttcgta

SEQ ID NO: 10033 - DNA, 20 bp, Artificial Sequence
  Description of Artificial Sequence: Synthetic oligonucleotide
  Target: SOD1; (+) strand; PAM type: NRG; PAM sequence: TGG
taagccacattttcgtaaag

SEQ ID NO: 10034 - DNA, 20 bp, Artificial Sequence
  Description of Artificial Sequence: Synthetic oligonucleotide
  Target: SOD1; (+) strand; PAM type: NRG; PAM sequence: CAG
tggctttaaaattgctctgc

SEQ ID NO: 10035 - DNA, 20 bp, Artificial Sequence
  Description of Artificial Sequence: Synthetic oligonucleotide
  Target: SOD1; (+) strand; PAM type: NRG; PAM sequence: TAG
ctttaaaattgctctgccag

SEQ ID NO: 10036 - DNA, 20 bp, Artificial Sequence
  Description of Artificial Sequence: Synthetic oligonucleotide
  Target: SOD1; (+) strand; PAM type: NRG; PAM sequence: AGG
tttaaaattgctctgccagt

SEQ ID NO: 10037 - DNA, 20 bp, Artificial Sequence
  Description of Artificial Sequence: Synthetic oligonucleotide
  Target: SOD1; (+) strand; PAM type: NRG; PAM sequence: CAG
aaaattgctctgccagtagg

SEQ ID NO: 10038 - DNA, 20 bp, Artificial Sequence
  Description of Artificial Sequence: Synthetic oligonucleotide
  Target: SOD1; (+) strand; PAM type: NRG; PAM sequence: AGG
aaattgctctgccagtaggc

SEQ ID NO: 10039 - DNA, 20 bp, Artificial Sequence
  Description of Artificial Sequence: Synthetic oligonucleotide
  Target: SOD1; (+) strand; PAM type: NRG; PAM sequence: AAG
ctgccagtaggcaggttgct

SEQ ID NO: 10040 - DNA, 20 bp, Artificial Sequence
  Description of Artificial Sequence: Synthetic oligonucleotide
  Target: SOD1; (+) strand; PAM type: NRG; PAM sequence: TGG
cagtaggcaggttgctaaga

SEQ ID NO: 10041 - DNA, 20 bp, Artificial Sequence
  Description of Artificial Sequence: Synthetic oligonucleotide
  Target: SOD1; (+) strand; PAM type: NRG; PAM sequence: CAG
aggcaggttgctaagatggt

SEQ ID NO: 10042 - DNA, 20 bp, Artificial Sequence
  Description of Artificial Sequence: Synthetic oligonucleotide
  Target: SOD1; (+) strand; PAM type: NRG; PAM sequence: GAG
gcaggttgctaagatggtca

SEQ ID NO: 10043 - DNA, 20 bp, Artificial Sequence
  Description of Artificial Sequence: Synthetic oligonucleotide
  Target: SOD1; (+) strand; PAM type: NRG; PAM sequence: CAG
aacgactcttgtaaaatata

SEQ ID NO: 10044 - DNA, 20 bp, Artificial Sequence
  Description of Artificial Sequence: Synthetic oligonucleotide
  Target: SOD1; (+) strand; PAM type: NRG; PAM sequence: CAG
aaaatatacagaaatatttt

SEQ ID NO: 10045 - DNA, 20 bp, Artificial Sequence
  Description of Artificial Sequence: Synthetic oligonucleotide
  Target: SOD1; (+) strand; PAM type: NRG; PAM sequence: CAG
aatattttcagaacttttat

SEQ ID NO: 10046 - DNA, 20 bp, Artificial Sequence
  Description of Artificial Sequence: Synthetic oligonucleotide
  Target: SOD1; (+) strand; PAM type: NRG; PAM sequence: AAG
aaaattacaaaacgtgttgc

SEQ ID NO: 10047 - DNA, 20 bp, Artificial Sequence
  Description of Artificial Sequence: Synthetic oligonucleotide
  Target: SOD1; (+) strand; PAM type: NRG; PAM sequence: AGG
aaattacaaaacgtgttgca

SEQ ID NO: 10048 - DNA, 20 bp, Artificial Sequence
  Description of Artificial Sequence: Synthetic oligonucleotide
  Target: SOD1; (+) strand; PAM type: NRG; PAM sequence: AAG
ttacaaaacgtgttgcaagg

SEQ ID NO: 10049 - DNA, 20 bp, Artificial Sequence
  Description of Artificial Sequence: Synthetic oligonucleotide
  Target: SOD1; (+) strand; PAM type: NRG; PAM sequence: AGG
tacaaaacgtgttgcaagga

SEQ ID NO: 10050 - DNA, 20 bp, Artificial Sequence
  Description of Artificial Sequence: Synthetic oligonucleotide
  Target: SOD1; (+) strand; PAM type: NRG; PAM sequence: CAG
gcttgtgataacactgtccc

SEQ ID NO: 10051 - DNA, 20 bp, Artificial Sequence
  Description of Artificial Sequence: Synthetic oligonucleotide
  Target: SOD1; (+) strand; PAM type: NRG; PAM sequence: TAG
taacactgtccccagaacct

SEQ ID NO: 10052 - DNA, 20 bp, Artificial Sequence
  Description of Artificial Sequence: Synthetic oligonucleotide
  Target: SOD1; (+) strand; PAM type: NRG; PAM sequence: AAG
ctgtccccagaaccttagtg

SEQ ID NO: 10053 - DNA, 20 bp, Artificial Sequence
  Description of Artificial Sequence: Synthetic oligonucleotide
  Target: SOD1; (+) strand; PAM type: NRG; PAM sequence: TGG
accttagtgaagttaccaac

SEQ ID NO: 10054 - DNA, 20 bp, Artificial Sequence
  Description of Artificial Sequence: Synthetic oligonucleotide
  Target: SOD1; (+) strand; PAM type: NRG; PAM sequence: TGG
ttagtgaagttaccaactgg

SEQ ID NO: 10055 - DNA, 20 bp, Artificial Sequence
  Description of Artificial Sequence: Synthetic oligonucleotide
  Target: SOD1; (+) strand; PAM type: NRG; PAM sequence: CGG
ggaaaattttctcttgcact

SEQ ID NO: 10056 - DNA, 20 bp, Artificial Sequence
  Description of Artificial Sequence: Synthetic oligonucleotide
  Target: SOD1; (+) strand; PAM type: NRG; PAM sequence: GAG
gcactcggcttaaaaatcat

SEQ ID NO: 10057 - DNA, 20 bp, Artificial Sequence
  Description of Artificial Sequence: Synthetic oligonucleotide
  Target: SOD1; (+) strand; PAM type: NRG; PAM sequence: AGG
cactcggcttaaaaatcatg

SEQ ID NO: 10058 - DNA, 20 bp, Artificial Sequence
  Description of Artificial Sequence: Synthetic oligonucleotide
  Target: SOD1; (+) strand; PAM type: NRG; PAM sequence: GGG
actcggcttaaaaatcatga

SEQ ID NO: 10059 - DNA, 20 bp, Artificial Sequence
  Description of Artificial Sequence: Synthetic oligonucleotide
  Target: SOD1; (+) strand; PAM type: NRG; PAM sequence: GAG
ggaatatttactatacgaat

SEQ ID NO: 10060 - DNA, 20 bp, Artificial Sequence
  Description of Artificial Sequence: Synthetic oligonucleotide
  Target: SOD1; (+) strand; PAM type: NRG; PAM sequence: CAG
tttactatacgaatgagatt

SEQ ID NO: 10061 - DNA, 20 bp, Artificial Sequence
  Description of Artificial Sequence: Synthetic oligonucleotide
  Target: SOD1; (+) strand; PAM type: NRG; PAM sequence: AAG
cgaatgagattcagtcttta

SEQ ID NO: 10062 - DNA, 20 bp, Artificial Sequence
  Description of Artificial Sequence: Synthetic oligonucleotide
  Target: SOD1; (+) strand; PAM type: NRG; PAM sequence: AGG
gaatgagattcagtctttaa

SEQ ID NO: 10063 - DNA, 20 bp, Artificial Sequence
  Description of Artificial Sequence: Synthetic oligonucleotide
  Target: SOD1; (+) strand; PAM type: NRG; PAM sequence: GGG
aatgagattcagtctttaaa

SEQ ID NO: 10064 - DNA, 20 bp, Artificial Sequence
  Description of Artificial Sequence: Synthetic oligonucleotide
  Target: SOD1; (+) strand; PAM type: NRG; PAM sequence: GGG
atgagattcagtctttaaag

SEQ ID NO: 10065 - DNA, 20 bp, Artificial Sequence
  Description of Artificial Sequence: Synthetic oligonucleotide
  Target: SOD1; (+) strand; PAM type: NRG; PAM sequence: CAG
tcagtctttaaaggggttta

SEQ ID NO: 10066 - DNA, 20 bp, Artificial Sequence
  Description of Artificial Sequence: Synthetic oligonucleotide
  Target: SOD1; (+) strand; PAM type: NRG; PAM sequence: GAG
aaaggggtttacagaaacgt

SEQ ID NO: 10067 - DNA, 20 bp, Artificial Sequence
  Description of Artificial Sequence: Synthetic oligonucleotide
  Target: SOD1; (+) strand; PAM type: NRG; PAM sequence: GAG
aggggtttacagaaacgtga

SEQ ID NO: 10068 - DNA, 20 bp, Artificial Sequence
  Description of Artificial Sequence: Synthetic oligonucleotide
  Target: SOD1; (+) strand; PAM type: NRG; PAM sequence: AGG
ggggtttacagaaacgtgag

SEQ ID NO: 10069 - DNA, 20 bp, Artificial Sequence
  Description of Artificial Sequence: Synthetic oligonucleotide
  Target: SOD1; (+) strand; PAM type: NRG; PAM sequence: CAG
tttacagaaacgtgagagga

SEQ ID NO: 10070 - DNA, 20 bp, Artificial Sequence
  Description of Artificial Sequence: Synthetic oligonucleotide
  Target: SOD1; (+) strand; PAM type: NRG; PAM sequence: AGG
ttacagaaacgtgagaggac

SEQ ID NO: 10071 - DNA, 20 bp, Artificial Sequence
  Description of Artificial Sequence: Synthetic oligonucleotide
  Target: SOD1; (+) strand; PAM type: NRG; PAM sequence: CAG
gaaacgtgagaggacaggaa

SEQ ID NO: 10072 - DNA, 20 bp, Artificial Sequence
  Description of Artificial Sequence: Synthetic oligonucleotide
  Target: SOD1; (+) strand; PAM type: NRG; PAM sequence: TAG
cgtgagaggacaggaacagt

SEQ ID NO: 10073 - DNA, 20 bp, Artificial Sequence
  Description of Artificial Sequence: Synthetic oligonucleotide
  Target: SOD1; (+) strand; PAM type: NRG; PAM sequence: GAG
taaatgtctgaaatatatgt

SEQ ID NO: 10074 - DNA, 20 bp, Artificial Sequence
  Description of Artificial Sequence: Synthetic oligonucleotide
  Target: SOD1; (+) strand; PAM type: NRG; PAM sequence: AGG
aaatgtctgaaatatatgtg

SEQ ID NO: 10075 - DNA, 20 bp, Artificial Sequence
  Description of Artificial Sequence: Synthetic oligonucleotide
  Target: SOD1; (+) strand; PAM type: NRG; PAM sequence: GGG
aatgtctgaaatatatgtga

SEQ ID NO: 10076 - DNA, 20 bp, Artificial Sequence
  Description of Artificial Sequence: Synthetic oligonucleotide
  Target: SOD1; (+) strand; PAM type: NRG; PAM sequence: GAG
tgtctgaaatatatgtgagg

SEQ ID NO: 10077 - DNA, 20 bp, Artificial Sequence
  Description of Artificial Sequence: Synthetic oligonucleotide
  Target: SOD1; (+) strand; PAM type: NRG; PAM sequence: GAG
atatatgtgagggagataat

SEQ ID NO: 10078 - DNA, 20 bp, Artificial Sequence
  Description of Artificial Sequence: Synthetic oligonucleotide
  Target: SOD1; (+) strand; PAM type: NRG; PAM sequence: TAG
tgtgagggagataatgagtt

SEQ ID NO: 10079 - DNA, 20 bp, Artificial Sequence
  Description of Artificial Sequence: Synthetic oligonucleotide
  Target: SOD1; (+) strand; PAM type: NRG; PAM sequence: TAG
agtttagcctttttctttaa

SEQ ID NO: 10080 - DNA, 20 bp, Artificial Sequence
  Description of Artificial Sequence: Synthetic oligonucleotide
  Target: SOD1; (+) strand; PAM type: NRG; PAM sequence: AGG
gtttagcctttttctttaat

SEQ ID NO: 10081 - DNA, 20 bp, Artificial Sequence
  Description of Artificial Sequence: Synthetic oligonucleotide
  Target: SOD1; (+) strand; PAM type: NRG; PAM sequence: CAG
ctttttctttaataggtctc

SEQ ID NO: 10082 - DNA, 20 bp, Artificial Sequence
  Description of Artificial Sequence: Synthetic oligonucleotide
  Target: SOD1; (+) strand; PAM type: NRG; PAM sequence: TGG
taataggtctccagattttc

SEQ ID NO: 10083 - DNA, 20 bp, Artificial Sequence
  Description of Artificial Sequence: Synthetic oligonucleotide
  Target: SOD1; (+) strand; PAM type: NRG; PAM sequence: AAG
ggtctccagattttctggaa

SEQ ID NO: 10084 - DNA, 20 bp, Artificial Sequence
  Description of Artificial Sequence: Synthetic oligonucleotide
  Target: SOD1; (+) strand; PAM type: NRG; PAM sequence: AGG
gtctccagattttctggaaa

SEQ ID NO: 10085 - DNA, 20 bp, Artificial Sequence
  Description of Artificial Sequence: Synthetic oligonucleotide
  Target: SOD1; (+) strand; PAM type: NRG; PAM sequence: TGG
attttctggaaaaggttctt

SEQ ID NO: 10086 - DNA, 20 bp, Artificial Sequence
  Description of Artificial Sequence: Synthetic oligonucleotide
  Target: SOD1; (+) strand; PAM type: NRG; PAM sequence: CAG
cattttgctgtttcatttgt

SEQ ID NO: 10087 - DNA, 20 bp, Artificial Sequence
  Description of Artificial Sequence: Synthetic oligonucleotide
  Target: SOD1; (+) strand; PAM type: NRG; PAM sequence: CAG
cttctccccacataattcac

SEQ ID NO: 10088 - DNA, 20 bp, Artificial Sequence
  Description of Artificial Sequence: Synthetic oligonucleotide
  Target: SOD1; (+) strand; PAM type: NRG; PAM sequence: TAG
cccacataattcaccagtac

SEQ ID NO: 10089 - DNA, 20 bp, Artificial Sequence
  Description of Artificial Sequence: Synthetic oligonucleotide
  Target: SOD1; (+) strand; PAM type: NRG; PAM sequence: CAG
agtactagtgttttgttttt

SEQ ID NO: 10090 - DNA, 20 bp, Artificial Sequence
  Description of Artificial Sequence: Synthetic oligonucleotide
  Target: SOD1; (+) strand; PAM type: NRG; PAM sequence: AAG
agtgttttgtttttcagacc

SEQ ID NO: 10091 - DNA, 20 bp, Artificial Sequence
  Description of Artificial Sequence: Synthetic oligonucleotide
  Target: SOD1; (+) strand; PAM type: NRG; PAM sequence: CAG
ccaagtctcgctctgtcgcc

SEQ ID NO: 10092 - DNA, 20 bp, Artificial Sequence
  Description of Artificial Sequence: Synthetic oligonucleotide
  Target: SOD1; (+) strand; PAM type: NRG; PAM sequence: AGG
caagtctcgctctgtcgccc

SEQ ID NO: 10093 - DNA, 20 bp, Artificial Sequence
  Description of Artificial Sequence: Synthetic oligonucleotide
  Target: SOD1; (+) strand; PAM type: NRG; PAM sequence: TGG
tctcgctctgtcgcccaggc

SEQ ID NO: 10094 - DNA, 20 bp, Artificial Sequence
  Description of Artificial Sequence: Synthetic oligonucleotide
  Target: SOD1; (+) strand; PAM type: NRG; PAM sequence: GAG
tcgctctgtcgcccaggctg

SEQ ID NO: 10095 - DNA, 20 bp, Artificial Sequence
  Description of Artificial Sequence: Synthetic oligonucleotide
  Target: SOD1; (+) strand; PAM type: NRG; PAM sequence: CAG
ctgtcgcccaggctggagtg

SEQ ID NO: 10096 - DNA, 20 bp, Artificial Sequence
  Description of Artificial Sequence: Synthetic oligonucleotide
  Target: SOD1; (+) strand; PAM type: NRG; PAM sequence: TGG
tcgcccaggctggagtgcag

SEQ ID NO: 10097 - DNA, 20 bp, Artificial Sequence
  Description of Artificial Sequence: Synthetic oligonucleotide
  Target: SOD1; (+) strand; PAM type: NRG; PAM sequence: CAG
ggagtgcagtggcgcgatct

SEQ ID NO: 10098 - DNA, 20 bp, Artificial Sequence
  Description of Artificial Sequence: Synthetic oligonucleotide
  Target: SOD1; (+) strand; PAM type: NRG; PAM sequence: CAG
tcactgcaacctccgcctcc

SEQ ID NO: 10099 - DNA, 20 bp, Artificial Sequence
  Description of Artificial Sequence: Synthetic oligonucleotide
  Target: SOD1; (+) strand; PAM type: NRG; PAM sequence: AGG
cactgcaacctccgcctccc

SEQ ID NO: 10100 - DNA, 20 bp, Artificial Sequence
  Description of Artificial Sequence: Synthetic oligonucleotide
  Target: SOD1; (+) strand; PAM type: NRG; PAM sequence: AAG
aacctccgcctcccaggttc

SEQ ID NO: 10101 - DNA, 20 bp, Artificial Sequence
  Description of Artificial Sequence: Synthetic oligonucleotide
  Target: SOD1; (+) strand; PAM type: NRG; PAM sequence: CAG
ttcaagcaattctcctgcct

SEQ ID NO: 10102 - DNA, 20 bp, Artificial Sequence
  Description of Artificial Sequence: Synthetic oligonucleotide
  Target: SOD1; (+) strand; PAM type: NRG; PAM sequence: CGG
attctcctgcctcagcctcc

SEQ ID NO: 10103 - DNA, 20 bp, Artificial Sequence
  Description of Artificial Sequence: Synthetic oligonucleotide
  Target: SOD1; (+) strand; PAM type: NRG; PAM sequence: GGG
ttctcctgcctcagcctccc

SEQ ID NO: 10104 - DNA, 20 bp, Artificial Sequence
  Description of Artificial Sequence: Synthetic oligonucleotide
  Target: SOD1; (+) strand; PAM type: NRG; PAM sequence: TAG
tcctgcctcagcctcccggg

SEQ ID NO: 10105 - DNA, 20 bp, Artificial Sequence
  Description of Artificial Sequence: Synthetic oligonucleotide
  Target: SOD1; (+) strand; PAM type: NRG; PAM sequence: TGG
gcctcagcctcccgggtagc

SEQ ID NO: 10106 - DNA, 20 bp, Artificial Sequence
  Description of Artificial Sequence: Synthetic oligonucleotide
  Target: SOD1; (+) strand; PAM type: NRG; PAM sequence: GGG
cctcagcctcccgggtagct

SEQ ID NO: 10107 - DNA, 20 bp, Artificial Sequence
  Description of Artificial Sequence: Synthetic oligonucleotide
  Target: SOD1; (+) strand; PAM type: NRG; PAM sequence: CAG
ctcccgggtagctgggacta

SEQ ID NO: 10108 - DNA, 20 bp, Artificial Sequence
  Description of Artificial Sequence: Synthetic oligonucleotide
  Target: SOD1; (+) strand; PAM type: NRG; PAM sequence: AGG
tcccgggtagctgggactac

SEQ ID NO: 10109 - DNA, 20 bp, Artificial Sequence
  Description of Artificial Sequence: Synthetic oligonucleotide
  Target: SOD1; (+) strand; PAM type: NRG; PAM sequence: TGG
caggcgcgcgccgccacgcc

SEQ ID NO: 10110 - DNA, 20 bp, Artificial Sequence
  Description of Artificial Sequence: Synthetic oligonucleotide
  Target: SOD1; (+) strand; PAM type: NRG; PAM sequence: TAG
ctggctaattttttatattt

SEQ ID NO: 10111 - DNA, 20 bp, Artificial Sequence
  Description of Artificial Sequence: Synthetic oligonucleotide
  Target: SOD1; (+) strand; PAM type: NRG; PAM sequence: TAG
gctaattttttatattttag

SEQ ID NO: 10112 - DNA, 20 bp, Artificial Sequence
  Description of Artificial Sequence: Synthetic oligonucleotide
  Target: SOD1; (+) strand; PAM type: NRG; PAM sequence: GAG
taattttttatattttagta

SEQ ID NO: 10113 - DNA, 20 bp, Artificial Sequence
  Description of Artificial Sequence: Synthetic oligonucleotide
  Target: SOD1; (+) strand; PAM type: NRG; PAM sequence: CGG
tttttatattttagtagaga

SEQ ID NO: 10114 - DNA, 20 bp, Artificial Sequence
  Description of Artificial Sequence: Synthetic oligonucleotide
  Target: SOD1; (+) strand; PAM type: NRG; PAM sequence: TGG
gagacggcgtttcaccatgt

SEQ ID NO: 10115 - DNA, 20 bp, Artificial Sequence
  Description of Artificial Sequence: Synthetic oligonucleotide
  Target: SOD1; (+) strand; PAM type: NRG; PAM sequence: CAG
cggcgtttcaccatgttggc

SEQ ID NO: 10116 - DNA, 20 bp, Artificial Sequence
  Description of Artificial Sequence: Synthetic oligonucleotide
  Target: SOD1; (+) strand; PAM type: NRG; PAM sequence: AGG
ggcgtttcaccatgttggcc

SEQ ID NO: 10117 - DNA, 20 bp, Artificial Sequence
  Description of Artificial Sequence: Synthetic oligonucleotide
  Target: SOD1; (+) strand; PAM type: NRG; PAM sequence: TGG
tttcaccatgttggccagga

SEQ ID NO: 10118 - DNA, 20 bp, Artificial Sequence
  Description of Artificial Sequence: Synthetic oligonucleotide
  Target: SOD1; (+) strand; PAM type: NRG; PAM sequence: CGG
acgtcgtgatccacccgcct

SEQ ID NO: 10119 - DNA, 20 bp, Artificial Sequence
  Description of Artificial Sequence: Synthetic oligonucleotide
  Target: SOD1; (+) strand; PAM type: NRG; PAM sequence: AAG
ccacccgcctcggcctccca

SEQ ID NO: 10120 - DNA, 20 bp, Artificial Sequence
  Description of Artificial Sequence: Synthetic oligonucleotide
  Target: SOD1; (+) strand; PAM type: NRG; PAM sequence: TGG
gcctcggcctcccaaagtgc

SEQ ID NO: 10121 - DNA, 20 bp, Artificial Sequence
  Description of Artificial Sequence: Synthetic oligonucleotide
  Target: SOD1; (+) strand; PAM type: NRG; PAM sequence: GGG
cctcggcctcccaaagtgct

SEQ ID NO: 10122 - DNA, 20 bp, Artificial Sequence
  Description of Artificial Sequence: Synthetic oligonucleotide
  Target: SOD1; (+) strand; PAM type: NRG; PAM sequence: CAG
ctcccaaagtgctgggatta

SEQ ID NO: 10123 - DNA, 20 bp, Artificial Sequence
  Description of Artificial Sequence: Synthetic oligonucleotide
  Target: SOD1; (+) strand; PAM type: NRG; PAM sequence: AGG
tcccaaagtgctgggattac

SEQ ID NO: 10124 - DNA, 20 bp, Artificial Sequence
  Description of Artificial Sequence: Synthetic oligonucleotide
  Target: SOD1; (+) strand; PAM type: NRG; PAM sequence: GAG
agtgctgggattacaggcgt

SEQ ID NO: 10125 - DNA, 20 bp, Artificial Sequence
  Description of Artificial Sequence: Synthetic oligonucleotide
  Target: SOD1; (+) strand; PAM type: NRG; PAM sequence: CGG
caggcgtgagccaccccgcc

SEQ ID NO: 10126 - DNA, 20 bp, Artificial Sequence
  Description of Artificial Sequence: Synthetic oligonucleotide
  Target: SOD1; (+) strand; PAM type: NRG; PAM sequence: CAG
gagccaccccgcccggccac

SEQ ID NO: 10127 - DNA, 20 bp, Artificial Sequence
  Description of Artificial Sequence: Synthetic oligonucleotide
  Target: SOD1; (+) strand; PAM type: NRG; PAM sequence: AAG
cggccaccagtgctattctt

SEQ ID NO: 10128 - DNA, 20 bp, Artificial Sequence
  Description of Artificial Sequence: Synthetic oligonucleotide
  Target: SOD1; (+) strand; PAM type: NRG; PAM sequence: GAG
gctattcttaagacgcctct

SEQ ID NO: 10129 - DNA, 20 bp, Artificial Sequence
  Description of Artificial Sequence: Synthetic oligonucleotide
  Target: SOD1; (+) strand; PAM type: NRG; PAM sequence: AGG
ctattcttaagacgcctctg

SEQ ID NO: 10130 - DNA, 20 bp, Artificial Sequence
  Description of Artificial Sequence: Synthetic oligonucleotide
  Target: SOD1; (+) strand; PAM type: NRG; PAM sequence: TGG
tctgaggaatcccttctccc

SEQ ID NO: 10131 - DNA, 20 bp, Artificial Sequence
  Description of Artificial Sequence: Synthetic oligonucleotide
  Target: SOD1; (+) strand; PAM type: NRG; PAM sequence: GAG
atcccttctccctggccatt

SEQ ID NO: 10132 - DNA, 20 bp, Artificial Sequence
  Description of Artificial Sequence: Synthetic oligonucleotide
  Target: SOD1; (+) strand; PAM type: NRG; PAM sequence: CAG
tgagaatccatgcatgaacc

SEQ ID NO: 10133 - DNA, 20 bp, Artificial Sequence
  Description of Artificial Sequence: Synthetic oligonucleotide
  Target: SOD1; (+) strand; PAM type: NRG; PAM sequence: AGG
gagaatccatgcatgaaccc

SEQ ID NO: 10134 - DNA, 20 bp, Artificial Sequence
  Description of Artificial Sequence: Synthetic oligonucleotide
  Target: SOD1; (+) strand; PAM type: NRG; PAM sequence: GAG
ccaggttttccaccttccct

SEQ ID NO: 10135 - DNA, 20 bp, Artificial Sequence
  Description of Artificial Sequence: Synthetic oligonucleotide
  Target: SOD1; (+) strand; PAM type: NRG; PAM sequence: CAG
ggttttccaccttccctgag

SEQ ID NO: 10136 - DNA, 20 bp, Artificial Sequence
  Description of Artificial Sequence: Synthetic oligonucleotide
  Target: SOD1; (+) strand; PAM type: NRG; PAM sequence: TAG
ccttccctgagcagcttgca

SEQ ID NO: 10137 - DNA, 20 bp, Artificial Sequence
  Description of Artificial Sequence: Synthetic oligonucleotide
  Target: SOD1; (+) strand; PAM type: NRG; PAM sequence: AAG
cttgcatagttccttctttt

SEQ ID NO: 10138 - DNA, 20 bp, Artificial Sequence
  Description of Artificial Sequence: Synthetic oligonucleotide
  Target: SOD1; (+) strand; PAM type: NRG; PAM sequence: TGG
gcgcctgacttcgttttgtt

SEQ ID NO: 10139 - DNA, 20 bp, Artificial Sequence
  Description of Artificial Sequence: Synthetic oligonucleotide
  Target: SOD1; (+) strand; PAM type: NRG; PAM sequence: GAG
gtttggtgcccgttgtacct

SEQ ID NO: 10140 - DNA, 20 bp, Artificial Sequence
  Description of Artificial Sequence: Synthetic oligonucleotide
  Target: SOD1; (+) strand; PAM type: NRG; PAM sequence: GAG
tgcccgttgtacctgagaat

SEQ ID NO: 10141 - DNA, 20 bp, Artificial Sequence
  Description of Artificial Sequence: Synthetic oligonucleotide
  Target: SOD1; (+) strand; PAM type: NRG; PAM sequence: TGG
ttgtacctgagaatgagcct

SEQ ID NO: 10142 - DNA, 20 bp, Artificial Sequence
  Description of Artificial Sequence: Synthetic oligonucleotide
  Target: SOD1; (+) strand; PAM type: NRG; PAM sequence: TAG
acctgagaatgagccttgga

SEQ ID NO: 10143 - DNA, 20 bp, Artificial Sequence
  Description of Artificial Sequence: Synthetic oligonucleotide
  Target: SOD1; (+) strand; PAM type: NRG; PAM sequence: TGG
tgagaatgagccttggatag

SEQ ID NO: 10144 - DNA, 20 bp, Artificial Sequence
  Description of Artificial Sequence: Synthetic oligonucleotide
  Target: SOD1; (+) strand; PAM type: NRG; PAM sequence: GAG
agaatgagccttggatagtg

SEQ ID NO: 10145 - DNA, 20 bp, Artificial Sequence
  Description of Artificial Sequence: Synthetic oligonucleotide
  Target: SOD1; (+) strand; PAM type: NRG; PAM sequence: CAG
ccttggatagtggagcattc

SEQ ID NO: 10146 - DNA, 20 bp, Artificial Sequence
  Description of Artificial Sequence: Synthetic oligonucleotide
  Target: SOD1; (+) strand; PAM type: NRG; PAM sequence: CAG
agtggagcattccagctttc

SEQ ID NO: 10147 - DNA, 20 bp, Artificial Sequence
  Description of Artificial Sequence: Synthetic oligonucleotide
  Target: SOD1; (+) strand; PAM type: NRG; PAM sequence: CAG
attccagctttccagatatg

SEQ ID NO: 10148 - DNA, 20 bp, Artificial Sequence
  Description of Artificial Sequence: Synthetic oligonucleotide
  Target: SOD1; (+) strand; PAM type: NRG; PAM sequence: GAG
tccagctttccagatatgca

SEQ ID NO: 10149 - DNA, 20 bp, Artificial Sequence
  Description of Artificial Sequence: Synthetic oligonucleotide
  Target: SOD1; (+) strand; PAM type: NRG; PAM sequence: TGG
gatatgcagagataatacat

SEQ ID NO: 10150 - DNA, 20 bp, Artificial Sequence
  Description of Artificial Sequence: Synthetic oligonucleotide
  Target: SOD1; (+) strand; PAM type: NRG; PAM sequence: CAG
agagataatacattggctat

SEQ ID NO: 10151 - DNA, 20 bp, Artificial Sequence
  Description of Artificial Sequence: Synthetic oligonucleotide
  Target: SOD1; (+) strand; PAM type: NRG; PAM sequence: TGG
tacattggctatcagctact

SEQ ID NO: 10152 - DNA, 20 bp, Artificial Sequence
  Description of Artificial Sequence: Synthetic oligonucleotide
  Target: SOD1; (+) strand; PAM type: NRG; PAM sequence: TGG
tggctatcagctacttggct

SEQ ID NO: 10153 - DNA, 20 bp, Artificial Sequence
  Description of Artificial Sequence: Synthetic oligonucleotide
  Target: SOD1; (+) strand; PAM type: NRG; PAM sequence: TGG
ctattccgtgtttaaaatct

SEQ ID NO: 10154 - DNA, 20 bp, Artificial Sequence
  Description of Artificial Sequence: Synthetic oligonucleotide
  Target: SOD1; (+) strand; PAM type: NRG; PAM sequence: TAG
taaaatcttggactctttgc

SEQ ID NO: 10155 - DNA, 20 bp, Artificial Sequence
  Description of Artificial Sequence: Synthetic oligonucleotide
  Target: SOD1; (+) strand; PAM type: NRG; PAM sequence: CAG
ggactctttgctagttttta

SEQ ID NO: 10156 - DNA, 20 bp, Artificial Sequence
  Description of Artificial Sequence: Synthetic oligonucleotide
  Target: SOD1; (+) strand; PAM type: NRG; PAM sequence: CAG
ctttgctagtttttacagat

SEQ ID NO: 10157 - DNA, 20 bp, Artificial Sequence
  Description of Artificial Sequence: Synthetic oligonucleotide
  Target: SOD1; (+) strand; PAM type: NRG; PAM sequence: CAG
gaatttttcacgtattaatc

SEQ ID NO: 10158 - DNA, 20 bp, Artificial Sequence
  Description of Artificial Sequence: Synthetic oligonucleotide
  Target: SOD1; (+) strand; PAM type: NRG; PAM sequence: TAG
acgtattaatccagttttcc

SEQ ID NO: 10159 - DNA, 20 bp, Artificial Sequence
  Description of Artificial Sequence: Synthetic oligonucleotide
  Target: SOD1; (+) strand; PAM type: NRG; PAM sequence: AAG
agttttcctagcttctcttg

SEQ ID NO: 10160 - DNA, 20 bp, Artificial Sequence
  Description of Artificial Sequence: Synthetic oligonucleotide
  Target: SOD1; (+) strand; PAM type: NRG; PAM sequence: TGG
agcttctcttgaagaatttt

SEQ ID NO: 10161 - DNA, 20 bp, Artificial Sequence
  Description of Artificial Sequence: Synthetic oligonucleotide
  Target: SOD1; (+) strand; PAM type: NRG; PAM sequence: GAG
cttctcttgaagaatttttg

SEQ ID NO: 10162 - DNA, 20 bp, Artificial Sequence
  Description of Artificial Sequence: Synthetic oligonucleotide
  Target: SOD1; (+) strand; PAM type: NRG; PAM sequence: GAG
tttggagatctcttcatact

SEQ ID NO: 10163 - DNA, 20 bp, Artificial Sequence
  Description of Artificial Sequence: Synthetic oligonucleotide
  Target: SOD1; (+) strand; PAM type: NRG; PAM sequence: TAG
tcttcatactgagccttcat

SEQ ID NO: 10164 - DNA, 20 bp, Artificial Sequence
  Description of Artificial Sequence: Synthetic oligonucleotide
  Target: SOD1; (+) strand; PAM type: NRG; PAM sequence: CAG
atactgagccttcattagcc

SEQ ID NO: 10165 - DNA, 20 bp, Artificial Sequence
  Description of Artificial Sequence: Synthetic oligonucleotide
  Target: SOD1; (+) strand; PAM type: NRG; PAM sequence: AGG
tactgagccttcattagccc

SEQ ID NO: 10166 - DNA, 20 bp, Artificial Sequence
  Description of Artificial Sequence: Synthetic oligonucleotide
  Target: SOD1; (+) strand; PAM type: NRG; PAM sequence: CAG
gagccttcattagcccagga

SEQ ID NO: 10167 - DNA, 20 bp, Artificial Sequence
  Description of Artificial Sequence: Synthetic oligonucleotide
  Target: SOD1; (+) strand; PAM type: NRG; PAM sequence: TAG
agcccaggacagtactgctg

SEQ ID NO: 10168 - DNA, 20 bp, Artificial Sequence
  Description of Artificial Sequence: Synthetic oligonucleotide
  Target: SOD1; (+) strand; PAM type: NRG; PAM sequence: CAG
ccaggacagtactgctgtag

SEQ ID NO: 10169 - DNA, 20 bp, Artificial Sequence
  Description of Artificial Sequence: Synthetic oligonucleotide
  Target: SOD1; (+) strand; PAM type: NRG; PAM sequence: CAG
tcatatattttttcgcttcc

SEQ ID NO: 10170 - DNA, 20 bp, Artificial Sequence
  Description of Artificial Sequence: Synthetic oligonucleotide
  Target: SOD1; (+) strand; PAM type: NRG; PAM sequence: AGG
catatattttttcgcttccc

SEQ ID NO: 10171 - DNA, 20 bp, Artificial Sequence
  Description of Artificial Sequence: Synthetic oligonucleotide
  Target: SOD1; (+) strand; PAM type: NRG; PAM sequence: AAG
caggcctgtgttattcactt

SEQ ID NO: 10172 - DNA, 20 bp, Artificial Sequence
  Description of Artificial Sequence: Synthetic oligonucleotide
  Target: SOD1; (+) strand; PAM type: NRG; PAM sequence: TAG
gtgttattcacttaagttca

SEQ ID NO: 10173 - DNA, 20 bp, Artificial Sequence
  Description of Artificial Sequence: Synthetic oligonucleotide
  Target: SOD1; (+) strand; PAM type: NRG; PAM sequence: TGG
attcacttaagttcatagcc

SEQ ID NO: 10174 - DNA, 20 bp, Artificial Sequence
  Description of Artificial Sequence: Synthetic oligonucleotide
  Target: SOD1; (+) strand; PAM type: NRG; PAM sequence: CAG
agttcatagcctggtccctg

SEQ ID NO: 10175 - DNA, 20 bp, Artificial Sequence
  Description of Artificial Sequence: Synthetic oligonucleotide
  Target: SOD1; (+) strand; PAM type: NRG; PAM sequence: AGG
gttcatagcctggtccctgc

SEQ ID NO: 10176 - DNA, 20 bp, Artificial Sequence
  Description of Artificial Sequence: Synthetic oligonucleotide
  Target: SOD1; (+) strand; PAM type: NRG; PAM sequence: GGG
ttcatagcctggtccctgca

SEQ ID NO: 10177 - DNA, 20 bp, Artificial Sequence
  Description of Artificial Sequence: Synthetic oligonucleotide
  Target: SOD1; (+) strand; PAM type: NRG; PAM sequence: GAG
gtccctgcagggttgtaccc

SEQ ID NO: 10178 - DNA, 20 bp, Artificial Sequence
  Description of Artificial Sequence: Synthetic oligonucleotide
  Target: SOD1; (+) strand; PAM type: NRG; PAM sequence: CAG
tgcagggttgtacccgagca

SEQ ID NO: 10179 - DNA, 20 bp, Artificial Sequence
  Description of Artificial Sequence: Synthetic oligonucleotide
  Target: SOD1; (+) strand; PAM type: NRG; PAM sequence: TAG
tgtacccgagcacagctact

SEQ ID NO: 10180 - DNA, 20 bp, Artificial Sequence
  Description of Artificial Sequence: Synthetic oligonucleotide
  Target: SOD1; (+) strand; PAM type: NRG; PAM sequence: CGG
agatgtcctgaatgtattac

SEQ ID NO: 10181 - DNA, 20 bp, Artificial Sequence
  Description of Artificial Sequence: Synthetic oligonucleotide
  Target: SOD1; (+) strand; PAM type: NRG; PAM sequence: TGG
tgaatgtattaccggttaaa

SEQ ID NO: 10182 - DNA, 20 bp, Artificial Sequence
  Description of Artificial Sequence: Synthetic oligonucleotide
  Target: SOD1; (+) strand; PAM type: NRG; PAM sequence: GAG
aatgtattaccggttaaatg

SEQ ID NO: 10183 - DNA, 20 bp, Artificial Sequence
  Description of Artificial Sequence: Synthetic oligonucleotide
  Target: SOD1; (+) strand; PAM type: NRG; PAM sequence: AGG
atgtattaccggttaaatgg

SEQ ID NO: 10184 - DNA, 20 bp, Artificial Sequence
  Description of Artificial Sequence: Synthetic oligonucleotide
  Target: SOD1; (+) strand; PAM type: NRG; PAM sequence: AAG
ccggttaaatggaggtttca

SEQ ID NO: 10185 - DNA, 20 bp, Artificial Sequence
  Description of Artificial Sequence: Synthetic oligonucleotide
  Target: SOD1; (+) strand; PAM type: NRG; PAM sequence: TGG
ttcaaagaacctgctgtttt

SEQ ID NO: 10186 - DNA, 20 bp, Artificial Sequence
  Description of Artificial Sequence: Synthetic oligonucleotide
  Target: SOD1; (+) strand; PAM type: NRG; PAM sequence: CAG
tggccctgtgctcttgataa

SEQ ID NO: 10187 - DNA, 20 bp, Artificial Sequence
  Description of Artificial Sequence: Synthetic oligonucleotide
  Target: SOD1; (+) strand; PAM type: NRG; PAM sequence: GAG
gccctgtgctcttgataaca

SEQ ID NO: 10188 - DNA, 20 bp, Artificial Sequence
  Description of Artificial Sequence: Synthetic oligonucleotide
  Target: SOD1; (+) strand; PAM type: NRG; PAM sequence: GAG
ctcttgataacagagtgttt

SEQ ID NO: 10189 - DNA, 20 bp, Artificial Sequence
  Description of Artificial Sequence: Synthetic oligonucleotide
  Target: SOD1; (+) strand; PAM type: NRG; PAM sequence: AGG
tcttgataacagagtgtttg

SEQ ID NO: 10190 - DNA, 20 bp, Artificial Sequence
  Description of Artificial Sequence: Synthetic oligonucleotide
  Target: SOD1; (+) strand; PAM type: NRG; PAM sequence: GGG
cttgataacagagtgtttga

SEQ ID NO: 10191 - DNA, 20 bp, Artificial Sequence
  Description of Artificial Sequence: Synthetic oligonucleotide
  Target: SOD1; (+) strand; PAM type: NRG; PAM sequence: GAG
gagggacaactttcacattt

SEQ ID NO: 10192 - DNA, 20 bp, Artificial Sequence
  Description of Artificial Sequence: Synthetic oligonucleotide
  Target: SOD1; (+) strand; PAM type: NRG; PAM sequence: AAG
tttgagtttttccaaaatta

SEQ ID NO: 10193 - DNA, 20 bp, Artificial Sequence
  Description of Artificial Sequence: Synthetic oligonucleotide
  Target: SOD1; (+) strand; PAM type: NRG; PAM sequence: AGG
ttgagtttttccaaaattaa

SEQ ID NO: 10194 - DNA, 20 bp, Artificial Sequence
  Description of Artificial Sequence: Synthetic oligonucleotide
  Target: SOD1; (+) strand; PAM type: NRG; PAM sequence: TAG
ttttccaaaattaaaggttg

SEQ ID NO: 10195 - DNA, 20 bp, Artificial Sequence
  Description of Artificial Sequence: Synthetic oligonucleotide
  Target: SOD1; (+) strand; PAM type: NRG; PAM sequence: AAG
tccaaaattaaaggttgtag

SEQ ID NO: 10196 - DNA, 20 bp, Artificial Sequence
  Description of Artificial Sequence: Synthetic oligonucleotide
  Target: SOD1; (+) strand; PAM type: NRG; PAM sequence: GAG
caaaattaaaggttgtagaa

SEQ ID NO: 10197 - DNA, 20 bp, Artificial Sequence
  Description of Artificial Sequence: Synthetic oligonucleotide
  Target: SOD1; (+) strand; PAM type: NRG; PAM sequence: CAG
taaaggttgtagaagagtca

SEQ ID NO: 10198 - DNA, 20 bp, Artificial Sequence
  Description of Artificial Sequence: Synthetic oligonucleotide
  Target: SOD1; (+) strand; PAM type: NRG; PAM sequence: AAG
tcacagtatctattgtcaaa

SEQ ID NO: 10199 - DNA, 20 bp, Artificial Sequence
  Description of Artificial Sequence: Synthetic oligonucleotide
  Target: SOD1; (+) strand; PAM type: NRG; PAM sequence: AAG
gtatctattgtcaaaaagaa

SEQ ID NO: 10200 - DNA, 20 bp, Artificial Sequence
  Description of Artificial Sequence: Synthetic oligonucleotide
  Target: SOD1; (+) strand; PAM type: NRG; PAM sequence: AAG
caaaaagaaaagaatttaaa

SEQ ID NO: 10201 - DNA, 20 bp, Artificial Sequence
  Description of Artificial Sequence: Synthetic oligonucleotide
  Target: SOD1; (+) strand; PAM type: NRG; PAM sequence: AGG
aaaaagaaaagaatttaaaa

SEQ ID NO: 10202 - DNA, 20 bp, Artificial Sequence
  Description of Artificial Sequence: Synthetic oligonucleotide
  Target: SOD1; (+) strand; PAM type: NRG; PAM sequence: CAG
aagaaaagaatttaaaaagg

SEQ ID NO: 10203 - DNA, 20 bp, Artificial Sequence
  Description of Artificial Sequence: Synthetic oligonucleotide
  Target: SOD1; (+) strand; PAM type: NRG; PAM sequence: CAG
tttaaaaaggcagcaattgc

SEQ ID NO: 10204 - DNA, 20 bp, Artificial Sequence
  Description of Artificial Sequence: Synthetic oligonucleotide
  Target: SOD1; (+) strand; PAM type: NRG; PAM sequence: AGG
ttaaaaaggcagcaattgcc

SEQ ID NO: 10205 - DNA, 20 bp, Artificial Sequence
  Description of Artificial Sequence: Synthetic oligonucleotide
  Target: SOD1; (+) strand; PAM type: NRG; PAM sequence: GAG
attgccaggatacttcattt

SEQ ID NO: 10206 - DNA, 20 bp, Artificial Sequence
  Description of Artificial Sequence: Synthetic oligonucleotide
  Target: SOD1; (+) strand; PAM type: NRG; PAM sequence: CAG
atttgagcaatgatattttc

SEQ ID NO: 10207 - DNA, 20 bp, Artificial Sequence
  Description of Artificial Sequence: Synthetic oligonucleotide
  Target: SOD1; (+) strand; PAM type: NRG; PAM sequence: TGG
tgagcaatgatattttccag

SEQ ID NO: 10208 - DNA, 20 bp, Artificial Sequence
  Description of Artificial Sequence: Synthetic oligonucleotide
  Target: SOD1; (+) strand; PAM type: NRG; PAM sequence: AAG
caatgatattttccagtgga

SEQ ID NO: 10209 - DNA, 20 bp, Artificial Sequence
  Description of Artificial Sequence: Synthetic oligonucleotide
  Target: SOD1; (+) strand; PAM type: NRG; PAM sequence: AAG
ccagtggaaagtcacatctt

SEQ ID NO: 10210 - DNA, 20 bp, Artificial Sequence
  Description of Artificial Sequence: Synthetic oligonucleotide
  Target: SOD1; (+) strand; PAM type: NRG; PAM sequence: AGG
cagtggaaagtcacatctta

SEQ ID NO: 10211 - DNA, 20 bp, Artificial Sequence
  Description of Artificial Sequence: Synthetic oligonucleotide
  Target: SOD1; (+) strand; PAM type: NRG; PAM sequence: GGG
agtggaaagtcacatcttaa

SEQ ID NO: 10212 - DNA, 20 bp, Artificial Sequence
  Description of Artificial Sequence: Synthetic oligonucleotide
  Target: SOD1; (+) strand; PAM type: NRG; PAM sequence: TGG
ggttaatgccccttaactgt

SEQ ID NO: 10213 - DNA, 20 bp, Artificial Sequence
  Description of Artificial Sequence: Synthetic oligonucleotide
  Target: SOD1; (+) strand; PAM type: NRG; PAM sequence: AAG
gccgtatttgaaaacaaacc

SEQ ID NO: 10214 - DNA, 20 bp, Artificial Sequence
  Description of Artificial Sequence: Synthetic oligonucleotide
  Target: SOD1; (+) strand; PAM type: NRG; PAM sequence: AAG
aaacaaaccaagctaaaaac

SEQ ID NO: 10215 - DNA, 20 bp, Artificial Sequence
  Description of Artificial Sequence: Synthetic oligonucleotide
  Target: SOD1; (+) strand; PAM type: NRG; PAM sequence: GAG
acaaaccaagctaaaaacaa

SEQ ID NO: 10216 - DNA, 20 bp, Artificial Sequence
  Description of Artificial Sequence: Synthetic oligonucleotide
  Target: SOD1; (+) strand; PAM type: NRG; PAM sequence: CGG
gacactgacatgttgtatga

SEQ ID NO: 10217 - DNA, 20 bp, Artificial Sequence
  Description of Artificial Sequence: Synthetic oligonucleotide
  Target: SOD1; (+) strand; PAM type: NRG; PAM sequence: TGG
tgacatgttgtatgacggtg

SEQ ID NO: 10218 - DNA, 20 bp, Artificial Sequence
  Description of Artificial Sequence: Synthetic oligonucleotide
  Target: SOD1; (+) strand; PAM type: NRG; PAM sequence: TGG
tgttgtatgacggtgtggtg

SEQ ID NO: 10219 - DNA, 20 bp, Artificial Sequence
  Description of Artificial Sequence: Synthetic oligonucleotide
  Target: SOD1; (+) strand; PAM type: NRG; PAM sequence: TAG
tgtggatgttgtgtttattt

SEQ ID NO: 10220 - DNA, 20 bp, Artificial Sequence
  Description of Artificial Sequence: Synthetic oligonucleotide
  Target: SOD1; (+) strand; PAM type: NRG; PAM sequence: GAG
gttgtgtttattttagtcct

SEQ ID NO: 10221 - DNA, 20 bp, Artificial Sequence
  Description of Artificial Sequence: Synthetic oligonucleotide
  Target: SOD1; (+) strand; PAM type: NRG; PAM sequence: TAG
tttattttagtcctgagatc

SEQ ID NO: 10222 - DNA, 20 bp, Artificial Sequence
  Description of Artificial Sequence: Synthetic oligonucleotide
  Target: SOD1; (+) strand; PAM type: NRG; PAM sequence: TAG
acttccttgatttctgtatg

SEQ ID NO: 10223 - DNA, 20 bp, Artificial Sequence
  Description of Artificial Sequence: Synthetic oligonucleotide
  Target: SOD1; (+) strand; PAM type: NRG; PAM sequence: CGG
ttgatttctgtatgtagcca

SEQ ID NO: 10224 - DNA, 20 bp, Artificial Sequence
  Description of Artificial Sequence: Synthetic oligonucleotide
  Target: SOD1; (+) strand; PAM type: NRG; PAM sequence: GAG
gatttctgtatgtagccacg

SEQ ID NO: 10225 - DNA, 20 bp, Artificial Sequence
  Description of Artificial Sequence: Synthetic oligonucleotide
  Target: SOD1; (+) strand; PAM type: NRG; PAM sequence: TGG
acctgtcaccattacctgaa

SEQ ID NO: 10226 - DNA, 20 bp, Artificial Sequence
  Description of Artificial Sequence: Synthetic oligonucleotide
  Target: SOD1; (+) strand; PAM type: NRG; PAM sequence: TGG
tatactgcttgctttcattt

SEQ ID NO: 10227 - DNA, 20 bp, Artificial Sequence
  Description of Artificial Sequence: Synthetic oligonucleotide
  Target: SOD1; (+) strand; PAM type: NRG; PAM sequence: TAG
actgcttgctttcattttgg

SEQ ID NO: 10228 - DNA, 20 bp, Artificial Sequence
  Description of Artificial Sequence: Synthetic oligonucleotide
  Target: SOD1; (+) strand; PAM type: NRG; PAM sequence: GAG
tgcttgctttcattttggta

SEQ ID NO: 10229 - DNA, 20 bp, Artificial Sequence
  Description of Artificial Sequence: Synthetic oligonucleotide
  Target: SOD1; (+) strand; PAM type: NRG; PAM sequence: TGG
ttgctttcattttggtagag

SEQ ID NO: 10230 - DNA, 20 bp, Artificial Sequence
  Description of Artificial Sequence: Synthetic oligonucleotide
  Target: SOD1; (+) strand; PAM type: NRG; PAM sequence: AAG
tttcattttggtagagtgga

SEQ ID NO: 10231 - DNA, 20 bp, Artificial Sequence
  Description of Artificial Sequence: Synthetic oligonucleotide
  Target: SOD1; (+) strand; PAM type: NRG; PAM sequence: AGG
ttcattttggtagagtggaa

SEQ ID NO: 10232 - DNA, 20 bp, Artificial Sequence
  Description of Artificial Sequence: Synthetic oligonucleotide
  Target: SOD1; (+) strand; PAM type: NRG; PAM sequence: TAG
ggtagagtggaaaggttacc

SEQ ID NO: 10233 - DNA, 20 bp, Artificial Sequence
  Description of Artificial Sequence: Synthetic oligonucleotide
  Target: SOD1; (+) strand; PAM type: NRG; PAM sequence: AGG
gtagagtggaaaggttacct

SEQ ID NO: 10234 - DNA, 20 bp, Artificial Sequence
  Description of Artificial Sequence: Synthetic oligonucleotide
  Target: SOD1; (+) strand; PAM type: NRG; PAM sequence: CAG
tggaaaggttacctaggttt

SEQ ID NO: 10235 - DNA, 20 bp, Artificial Sequence
  Description of Artificial Sequence: Synthetic oligonucleotide
  Target: SOD1; (+) strand; PAM type: NRG; PAM sequence: AAG
cctaggtttcagtgcttgaa

SEQ ID NO: 10236 - DNA, 20 bp, Artificial Sequence
  Description of Artificial Sequence: Synthetic oligonucleotide
  Target: SOD1; (+) strand; PAM type: NRG; PAM sequence: CAG
ttcagtgcttgaaaagattt

SEQ ID NO: 10237 - DNA, 20 bp, Artificial Sequence
  Description of Artificial Sequence: Synthetic oligonucleotide
  Target: SOD1; (+) strand; PAM type: NRG; PAM sequence: AAG
gtgcttgaaaagatttcaga

SEQ ID NO: 10238 - DNA, 20 bp, Artificial Sequence
  Description of Artificial Sequence: Synthetic oligonucleotide
  Target: SOD1; (+) strand; PAM type: NRG; PAM sequence: CAG
cttgaaaagatttcagaaag

SEQ ID NO: 10239 - DNA, 20 bp, Artificial Sequence
  Description of Artificial Sequence: Synthetic oligonucleotide
  Target: SOD1; (+) strand; PAM type: NRG; PAM sequence: TAG
gaaaagatttcagaaagcag

SEQ ID NO: 10240 - DNA, 20 bp, Artificial Sequence
  Description of Artificial Sequence: Synthetic oligonucleotide
  Target: SOD1; (+) strand; PAM type: NRG; PAM sequence: TGG
tcagaaagcagtagtacgtc

SEQ ID NO: 10241 - DNA, 20 bp, Artificial Sequence
  Description of Artificial Sequence: Synthetic oligonucleotide
  Target: SOD1; (+) strand; PAM type: NRG; PAM sequence: TAG
aaagcagtagtacgtctggt

SEQ ID NO: 10242 - DNA, 20 bp, Artificial Sequence
  Description of Artificial Sequence: Synthetic oligonucleotide
  Target: SOD1; (+) strand; PAM type: NRG; PAM sequence: TAG
agtagtacgtctggttagac

SEQ ID NO: 10243 - DNA, 20 bp, Artificial Sequence
  Description of Artificial Sequence: Synthetic oligonucleotide
  Target: SOD1; (+) strand; PAM type: NRG; PAM sequence: CAG
acgtctggttagactagaat

SEQ ID NO: 10244 - DNA, 20 bp, Artificial Sequence
  Description of Artificial Sequence: Synthetic oligonucleotide
  Target: SOD1; (+) strand; PAM type: NRG; PAM sequence: TGG
gactagaatcagtcctctcc

SEQ ID NO: 10245 - DNA, 20 bp, Artificial Sequence
  Description of Artificial Sequence: Synthetic oligonucleotide
  Target: SOD1; (+) strand; PAM type: NRG; PAM sequence: GGG
actagaatcagtcctctcct

SEQ ID NO: 10246 - DNA, 20 bp, Artificial Sequence
  Description of Artificial Sequence: Synthetic oligonucleotide
  Target: SOD1; (+) strand; PAM type: NRG; PAM sequence: GGG
ctagaatcagtcctctcctg

SEQ ID NO: 10247 - DNA, 20 bp, Artificial Sequence
  Description of Artificial Sequence: Synthetic oligonucleotide
  Target: SOD1; (+) strand; PAM type: NRG; PAM sequence: GGG
tagaatcagtcctctcctgg

SEQ ID NO: 10248 - DNA, 20 bp, Artificial Sequence
  Description of Artificial Sequence: Synthetic oligonucleotide
  Target: SOD1; (+) strand; PAM type: NRG; PAM sequence: CAG
aatcagtcctctcctggggg

SEQ ID NO: 10249 - DNA, 20 bp, Artificial Sequence
  Description of Artificial Sequence: Synthetic oligonucleotide
  Target: SOD1; (+) strand; PAM type: NRG; PAM sequence: TGG
cagtcctctcctgggggcag

SEQ ID NO: 10250 - DNA, 20 bp, Artificial Sequence
  Description of Artificial Sequence: Synthetic oligonucleotide
  Target: SOD1; (+) strand; PAM type: NRG; PAM sequence: TAG
ctaattaaaaatacctgtga

SEQ ID NO: 10251 - DNA, 20 bp, Artificial Sequence
  Description of Artificial Sequence: Synthetic oligonucleotide
  Target: SOD1; (+) strand; PAM type: NRG; PAM sequence: CGG
ttaaaaatacctgtgatagc

SEQ ID NO: 10252 - DNA, 20 bp, Artificial Sequence
  Description of Artificial Sequence: Synthetic oligonucleotide
  Target: SOD1; (+) strand; PAM type: NRG; PAM sequence: GGG
taaaaatacctgtgatagcc

SEQ ID NO: 10253 - DNA, 20 bp, Artificial Sequence
  Description of Artificial Sequence: Synthetic oligonucleotide
  Target: SOD1; (+) strand; PAM type: NRG; PAM sequence: TGG
atacctgtgatagccgggcg

SEQ ID NO: 10254 - DNA, 20 bp, Artificial Sequence
  Description of Artificial Sequence: Synthetic oligonucleotide
  Target: SOD1; (+) strand; PAM type: NRG; PAM sequence: TGG
cctgtgatagccgggcgtgg

SEQ ID NO: 10255 - DNA, 20 bp, Artificial Sequence
  Description of Artificial Sequence: Synthetic oligonucleotide
  Target: SOD1; (+) strand; PAM type: NRG; PAM sequence: CAG
gtggcttacgcctgtaatcc

SEQ ID NO: 10256 - DNA, 20 bp, Artificial Sequence
  Description of Artificial Sequence: Synthetic oligonucleotide
  Target: SOD1; (+) strand; PAM type: NRG; PAM sequence: TGG
cgcctgtaatcccagcactt

SEQ ID NO: 10257 - DNA, 20 bp, Artificial Sequence
  Description of Artificial Sequence: Synthetic oligonucleotide
  Target: SOD1; (+) strand; PAM type: NRG; PAM sequence: GGG
gcctgtaatcccagcacttt

SEQ ID NO: 10258 - DNA, 20 bp, Artificial Sequence
  Description of Artificial Sequence: Synthetic oligonucleotide
  Target: SOD1; (+) strand; PAM type: NRG; PAM sequence: GAG
ctgtaatcccagcactttgg

SEQ ID NO: 10259 - DNA, 20 bp, Artificial Sequence
  Description of Artificial Sequence: Synthetic oligonucleotide
  Target: SOD1; (+) strand; PAM type: NRG; PAM sequence: AGG
tgtaatcccagcactttggg

SEQ ID NO: 10260 - DNA, 20 bp, Artificial Sequence
  Description of Artificial Sequence: Synthetic oligonucleotide
  Target: SOD1; (+) strand; PAM type: NRG; PAM sequence: GAG
tcccagcactttgggaggcc

SEQ ID NO: 10261 - DNA, 20 bp, Artificial Sequence
  Description of Artificial Sequence: Synthetic oligonucleotide
  Target: SOD1; (+) strand; PAM type: NRG; PAM sequence: CGG
agcactttgggaggccgaga

SEQ ID NO: 10262 - DNA, 20 bp, Artificial Sequence
  Description of Artificial Sequence: Synthetic oligonucleotide
  Target: SOD1; (+) strand; PAM type: NRG; PAM sequence: GGG
gcactttgggaggccgagac

SEQ ID NO: 10263 - DNA, 20 bp, Artificial Sequence
  Description of Artificial Sequence: Synthetic oligonucleotide
  Target: SOD1; (+) strand; PAM type: NRG; PAM sequence: TGG
ctttgggaggccgagacggg

SEQ ID NO: 10264 - DNA, 20 bp, Artificial Sequence
  Description of Artificial Sequence: Synthetic oligonucleotide
  Target: SOD1; (+) strand; PAM type: NRG; PAM sequence: GAG
ggccgagacgggtggatcac

SEQ ID NO: 10265 - DNA, 20 bp, Artificial Sequence
  Description of Artificial Sequence: Synthetic oligonucleotide
  Target: SOD1; (+) strand; PAM type: NRG; PAM sequence: AGG
gccgagacgggtggatcacg

SEQ ID NO: 10266 - DNA, 20 bp, Artificial Sequence
  Description of Artificial Sequence: Synthetic oligonucleotide
  Target: SOD1; (+) strand; PAM type: NRG; PAM sequence: CAG
agacgggtggatcacgaggt

SEQ ID NO: 10267 - DNA, 20 bp, Artificial Sequence
  Description of Artificial Sequence: Synthetic oligonucleotide
  Target: SOD1; (+) strand; PAM type: NRG; PAM sequence: CAG
cgggtggatcacgaggtcag

SEQ ID NO: 10268 - DNA, 20 bp, Artificial Sequence
  Description of Artificial Sequence: Synthetic oligonucleotide
  Target: SOD1; (+) strand; PAM type: NRG; PAM sequence: TGG
tggatcacgaggtcagcaga

SEQ ID NO: 10269 - DNA, 20 bp, Artificial Sequence
  Description of Artificial Sequence: Synthetic oligonucleotide
  Target: SOD1; (+) strand; PAM type: NRG; PAM sequence: GAG
gatcacgaggtcagcagatg

SEQ ID NO: 10270 - DNA, 20 bp, Artificial Sequence
  Description of Artificial Sequence: Synthetic oligonucleotide
  Target: SOD1; (+) strand; PAM type: NRG; PAM sequence: TGG
tcagcagatggagaccatcc

SEQ ID NO: 10271 - DNA, 20 bp, Artificial Sequence
  Description of Artificial Sequence: Synthetic oligonucleotide
  Target: SOD1; (+) strand; PAM type: NRG; PAM sequence: CGG
ggagaccatcctggctaaca

SEQ ID NO: 10272 - DNA, 20 bp, Artificial Sequence
  Description of Artificial Sequence: Synthetic oligonucleotide
  Target: SOD1; (+) strand; PAM type: NRG; PAM sequence: TAG
tactaaaaatgcaaaaaaat

SEQ ID NO: 10273 - DNA, 20 bp, Artificial Sequence
  Description of Artificial Sequence: Synthetic oligonucleotide
  Target: SOD1; (+) strand; PAM type: NRG; PAM sequence: CGG
aaaaatgcaaaaaaattagc

SEQ ID NO: 10274 - DNA, 20 bp, Artificial Sequence
  Description of Artificial Sequence: Synthetic oligonucleotide
  Target: SOD1; (+) strand; PAM type: NRG; PAM sequence: GGG
aaaatgcaaaaaaattagcc

SEQ ID NO: 10275 - DNA, 20 bp, Artificial Sequence
  Description of Artificial Sequence: Synthetic oligonucleotide
  Target: SOD1; (+) strand; PAM type: NRG; PAM sequence: TGG
gcaaaaaaattagccgggtg

SEQ ID NO: 10276 - DNA, 20 bp, Artificial Sequence
  Description of Artificial Sequence: Synthetic oligonucleotide
  Target: SOD1; (+) strand; PAM type: NRG; PAM sequence: TGG
aaaaaattagccgggtgtgg

SEQ ID NO: 10277 - DNA, 20 bp, Artificial Sequence
  Description of Artificial Sequence: Synthetic oligonucleotide
  Target: SOD1; (+) strand; PAM type: NRG; PAM sequence: TGG
aaattagccgggtgtggtgg

SEQ ID NO: 10278 - DNA, 20 bp, Artificial Sequence
  Description of Artificial Sequence: Synthetic oligonucleotide
  Target: SOD1; (+) strand; PAM type: NRG; PAM sequence: GGG
aattagccgggtgtggtggt

SEQ ID NO: 10279 - DNA, 20 bp, Artificial Sequence
  Description of Artificial Sequence: Synthetic oligonucleotide
  Target: SOD1; (+) strand; PAM type: NRG; PAM sequence: TAG
ggtgtggtggtgggcgcctg

SEQ ID NO: 10280 - DNA, 20 bp, Artificial Sequence
  Description of Artificial Sequence: Synthetic oligonucleotide
  Target: SOD1; (+) strand; PAM type: NRG; PAM sequence: CAG
gtggtgggcgcctgtagtcc

SEQ ID NO: 10281 - DNA, 20 bp, Artificial Sequence
  Description of Artificial Sequence: Synthetic oligonucleotide
  Target: SOD1; (+) strand; PAM type: NRG; PAM sequence: CAG
cgcctgtagtcccagctact

SEQ ID NO: 10282 - DNA, 20 bp, Artificial Sequence
  Description of Artificial Sequence: Synthetic oligonucleotide
  Target: SOD1; (+) strand; PAM type: NRG; PAM sequence: AGG
gcctgtagtcccagctactc

SEQ ID NO: 10283 - DNA, 20 bp, Artificial Sequence
  Description of Artificial Sequence: Synthetic oligonucleotide
  Target: SOD1; (+) strand; PAM type: NRG; PAM sequence: GAG
ctgtagtcccagctactcag

SEQ ID NO: 10284 - DNA, 20 bp, Artificial Sequence
  Description of Artificial Sequence: Synthetic oligonucleotide
  Target: SOD1; (+) strand; PAM type: NRG; PAM sequence: AGG
tgtagtcccagctactcagg

SEQ ID NO: 10285 - DNA, 20 bp, Artificial Sequence
  Description of Artificial Sequence: Synthetic oligonucleotide
  Target: SOD1; (+) strand; PAM type: NRG; PAM sequence: GAG
tcccagctactcaggaggct

SEQ ID NO: 10286 - DNA, 20 bp, Artificial Sequence
  Description of Artificial Sequence: Synthetic oligonucleotide
  Target: SOD1; (+) strand; PAM type: NRG; PAM sequence: AGG
cccagctactcaggaggctg

SEQ ID NO: 10287 - DNA, 20 bp, Artificial Sequence
  Description of Artificial Sequence: Synthetic oligonucleotide
  Target: SOD1; (+) strand; PAM type: NRG; PAM sequence: CAG
agctactcaggaggctgagg

SEQ ID NO: 10288 - DNA, 20 bp, Artificial Sequence
  Description of Artificial Sequence: Synthetic oligonucleotide
  Target: SOD1; (+) strand; PAM type: NRG; PAM sequence: AGG
gctactcaggaggctgaggc

SEQ ID NO: 10289 - DNA, 20 bp, Artificial Sequence
  Description of Artificial Sequence: Synthetic oligonucleotide
  Target: SOD1; (+) strand; PAM type: NRG; PAM sequence: GAG
tactcaggaggctgaggcag

SEQ ID NO: 10290 - DNA, 20 bp, Artificial Sequence
  Description of Artificial Sequence: Synthetic oligonucleotide
  Target: SOD1; (+) strand; PAM type: NRG; PAM sequence: TGG
aggaggctgaggcaggagaa

SEQ ID NO: 10291 - DNA, 20 bp, Artificial Sequence
  Description of Artificial Sequence: Synthetic oligonucleotide
  Target: SOD1; (+) strand; PAM type: NRG; PAM sequence: TGG
gcaggagaatggcatgaacc

SEQ ID NO: 10292 - DNA, 20 bp, Artificial Sequence
  Description of Artificial Sequence: Synthetic oligonucleotide
  Target: SOD1; (+) strand; PAM type: NRG; PAM sequence: GGG
caggagaatggcatgaacct

SEQ ID NO: 10293 - DNA, 20 bp, Artificial Sequence
  Description of Artificial Sequence: Synthetic oligonucleotide
  Target: SOD1; (+) strand; PAM type: NRG; PAM sequence: GAG
ggagaatggcatgaacctgg

SEQ ID NO: 10294 - DNA, 20 bp, Artificial Sequence
  Description of Artificial Sequence: Synthetic oligonucleotide
  Target: SOD1; (+) strand; PAM type: NRG; PAM sequence: AGG
gagaatggcatgaacctggg

SEQ ID NO: 10295 - DNA, 20 bp, Artificial Sequence
  Description of Artificial Sequence: Synthetic oligonucleotide
  Target: SOD1; (+) strand; PAM type: NRG; PAM sequence: CGG
aatggcatgaacctgggagg

SEQ ID NO: 10296 - DNA, 20 bp, Artificial Sequence
  Description of Artificial Sequence: Synthetic oligonucleotide
  Target: SOD1; (+) strand; PAM type: NRG; PAM sequence: GAG
tggcatgaacctgggaggcg

SEQ ID NO: 10297 - DNA, 20 bp, Artificial Sequence
  Description of Artificial Sequence: Synthetic oligonucleotide
  Target: SOD1; (+) strand; PAM type: NRG; PAM sequence: CAG
aacctgggaggcggagcttg

SEQ ID NO: 10298 - DNA, 20 bp, Artificial Sequence
  Description of Artificial Sequence: Synthetic oligonucleotide
  Target: SOD1; (+) strand; PAM type: NRG; PAM sequence: GAG
tgggaggcggagcttgcagt

SEQ ID NO: 10299 - DNA, 20 bp, Artificial Sequence
  Description of Artificial Sequence: Synthetic oligonucleotide
  Target: SOD1; (+) strand; PAM type: NRG; PAM sequence: GAG
ggcggagcttgcagtgagcc

SEQ ID NO: 10300 - DNA, 20 bp, Artificial Sequence
  Description of Artificial Sequence: Synthetic oligonucleotide
  Target: SOD1; (+) strand; PAM type: NRG; PAM sequence: CAG
gagatcatgtcactgcactc

SEQ ID NO: 10301 - DNA, 20 bp, Artificial Sequence
  Description of Artificial Sequence: Synthetic oligonucleotide
  Target: SOD1; (+) strand; PAM type: NRG; PAM sequence: TGG
catgtcactgcactccagcc

SEQ ID NO: 10302 - DNA, 20 bp, Artificial Sequence
  Description of Artificial Sequence: Synthetic oligonucleotide
  Target: SOD1; (+) strand; PAM type: NRG; PAM sequence: GGG
atgtcactgcactccagcct

SEQ ID NO: 10303 - DNA, 20 bp, Artificial Sequence
  Description of Artificial Sequence: Synthetic oligonucleotide
  Target: SOD1; (+) strand; PAM type: NRG; PAM sequence: CAG
ctgcactccagcctgggcga

SEQ ID NO: 10304 - DNA, 20 bp, Artificial Sequence
  Description of Artificial Sequence: Synthetic oligonucleotide
  Target: SOD1; (+) strand; PAM type: NRG; PAM sequence: GAG
gcactccagcctgggcgaca

SEQ ID NO: 10305 - DNA, 20 bp, Artificial Sequence
  Description of Artificial Sequence: Synthetic oligonucleotide
  Target: SOD1; (+) strand; PAM type: NRG; PAM sequence: GAG
tccagcctgggcgacagagc

SEQ ID NO: 10306 - DNA, 20 bp, Artificial Sequence
  Description of Artificial Sequence: Synthetic oligonucleotide
  Target: SOD1; (+) strand; PAM type: NRG; PAM sequence: AAG
agactcgtctcaaaaaaaaa

SEQ ID NO: 10307 - DNA, 20 bp, Artificial Sequence
  Description of Artificial Sequence: Synthetic oligonucleotide
  Target: SOD1; (+) strand; PAM type: NRG; PAM sequence: TGG
aaaaagaaaaaaacttatga

SEQ ID NO: 10308 - DNA, 20 bp, Artificial Sequence
  Description of Artificial Sequence: Synthetic oligonucleotide
  Target: SOD1; (+) strand; PAM type: NRG; PAM sequence: GAG
gacacttaaaaacactcact

SEQ ID NO: 10309 - DNA, 20 bp, Artificial Sequence
  Description of Artificial Sequence: Synthetic oligonucleotide
  Target: SOD1; (+) strand; PAM type: NRG; PAM sequence: TGG
acttaaaaacactcactgag

SEQ ID NO: 10310 - DNA, 20 bp, Artificial Sequence
  Description of Artificial Sequence: Synthetic oligonucleotide
  Target: SOD1; (+) strand; PAM type: NRG; PAM sequence: GGG
cttaaaaacactcactgagt

SEQ ID NO: 10311 - DNA, 20 bp, Artificial Sequence
  Description of Artificial Sequence: Synthetic oligonucleotide
  Target: SOD1; (+) strand; PAM type: NRG; PAM sequence: GGG
ttaaaaacactcactgagtg

SEQ ID NO: 10312 - DNA, 20 bp, Artificial Sequence
  Description of Artificial Sequence: Synthetic oligonucleotide
  Target: SOD1; (+) strand; PAM type: NRG; PAM sequence: GAG
aaaaacactcactgagtggg

SEQ ID NO: 10313 - DNA, 20 bp, Artificial Sequence
  Description of Artificial Sequence: Synthetic oligonucleotide
  Target: SOD1; (+) strand; PAM type: NRG; PAM sequence: TGG
aacactcactgagtggggag

SEQ ID NO: 10314 - DNA, 20 bp, Artificial Sequence
  Description of Artificial Sequence: Synthetic oligonucleotide
  Target: SOD1; (+) strand; PAM type: NRG; PAM sequence: GAG
cactcactgagtggggagtg

SEQ ID NO: 10315 - DNA, 20 bp, Artificial Sequence
  Description of Artificial Sequence: Synthetic oligonucleotide
  Target: SOD1; (+) strand; PAM type: NRG; PAM sequence: GAG
ctcactgagtggggagtgga

SEQ ID NO: 10316 - DNA, 20 bp, Artificial Sequence
  Description of Artificial Sequence: Synthetic oligonucleotide
  Target: SOD1; (+) strand; PAM type: NRG; PAM sequence: CAG
actgagtggggagtggagag

SEQ ID NO: 10317 - DNA, 20 bp, Artificial Sequence
  Description of Artificial Sequence: Synthetic oligonucleotide
  Target: SOD1; (+) strand; PAM type: NRG; PAM sequence: AGG
ctgagtggggagtggagagc

SEQ ID NO: 10318 - DNA, 20 bp, Artificial Sequence
  Description of Artificial Sequence: Synthetic oligonucleotide
  Target: SOD1; (+) strand; PAM type: NRG; PAM sequence: GGG
tgagtggggagtggagagca

SEQ ID NO: 10319 - DNA, 20 bp, Artificial Sequence
  Description of Artificial Sequence: Synthetic oligonucleotide
  Target: SOD1; (+) strand; PAM type: NRG; PAM sequence: GGG
gagtggggagtggagagcag

SEQ ID NO: 10320 - DNA, 20 bp, Artificial Sequence
  Description of Artificial Sequence: Synthetic oligonucleotide
  Target: SOD1; (+) strand; PAM type: NRG; PAM sequence: CAG
ggagtggagagcaggggtcc

SEQ ID NO: 10321 - DNA, 20 bp, Artificial Sequence
  Description of Artificial Sequence: Synthetic oligonucleotide
  Target: SOD1; (+) strand; PAM type: NRG; PAM sequence: AGG
gagtggagagcaggggtccc

SEQ ID NO: 10322 - DNA, 20 bp, Artificial Sequence
  Description of Artificial Sequence: Synthetic oligonucleotide
  Target: SOD1; (+) strand; PAM type: NRG; PAM sequence: GGG
agtggagagcaggggtccca

SEQ ID NO: 10323 - DNA, 20 bp, Artificial Sequence
  Description of Artificial Sequence: Synthetic oligonucleotide
  Target: SOD1; (+) strand; PAM type: NRG; PAM sequence: TAG
ggagagcaggggtcccaggg

SEQ ID NO: 10324 - DNA, 20 bp, Artificial Sequence
  Description of Artificial Sequence: Synthetic oligonucleotide
  Target: SOD1; (+) strand; PAM type: NRG; PAM sequence: TGG
ggggtcccagggtagcctgt

SEQ ID NO: 10325 - DNA, 20 bp, Artificial Sequence
  Description of Artificial Sequence: Synthetic oligonucleotide
  Target: SOD1; (+) strand; PAM type: NRG; PAM sequence: CAG
ggtagcctgttggacatttc

SEQ ID NO: 10326 - DNA, 20 bp, Artificial Sequence
  Description of Artificial Sequence: Synthetic oligonucleotide
  Target: SOD1; (+) strand; PAM type: NRG; PAM sequence: AGG
gtagcctgttggacatttcc

SEQ ID NO: 10327 - DNA, 20 bp, Artificial Sequence
  Description of Artificial Sequence: Synthetic oligonucleotide
  Target: SOD1; (+) strand; PAM type: NRG; PAM sequence: GGG
tagcctgttggacatttcca

SEQ ID NO: 10328 - DNA, 20 bp, Artificial Sequence
  Description of Artificial Sequence: Synthetic oligonucleotide
  Target: SOD1; (+) strand; PAM type: NRG; PAM sequence: AAG
tttttcttttttttttttta

SEQ ID NO: 10329 - DNA, 20 bp, Artificial Sequence
  Description of Artificial Sequence: Synthetic oligonucleotide
  Target: SOD1; (+) strand; PAM type: NRG; PAM sequence: AAG
ctttttttttttttaaagtc

SEQ ID NO: 10330 - DNA, 20 bp, Artificial Sequence
  Description of Artificial Sequence: Synthetic oligonucleotide
  Target: SOD1; (+) strand; PAM type: NRG; PAM sequence: GAG
ttttttttttaaagtcaagt

SEQ ID NO: 10331 - DNA, 20 bp, Artificial Sequence
  Description of Artificial Sequence: Synthetic oligonucleotide
  Target: SOD1; (+) strand; PAM type: NRG; PAM sequence: TGG
agtcaagtgagtatgccata

SEQ ID NO: 10332 - DNA, 20 bp, Artificial Sequence
  Description of Artificial Sequence: Synthetic oligonucleotide
  Target: SOD1; (+) strand; PAM type: NRG; PAM sequence: AAG
agtgagtatgccatatggaa

SEQ ID NO: 10333 - DNA, 20 bp, Artificial Sequence
  Description of Artificial Sequence: Synthetic oligonucleotide
  Target: SOD1; (+) strand; PAM type: NRG; PAM sequence: AGG
gtgagtatgccatatggaaa

SEQ ID NO: 10334 - DNA, 20 bp, Artificial Sequence
  Description of Artificial Sequence: Synthetic oligonucleotide
  Target: SOD1; (+) strand; PAM type: NRG; PAM sequence: GGG
tgagtatgccatatggaaaa

SEQ ID NO: 10335 - DNA, 20 bp, Artificial Sequence
  Description of Artificial Sequence: Synthetic oligonucleotide
  Target: SOD1; (+) strand; PAM type: NRG; PAM sequence: TGG
catatggaaaagggtgtgcg

SEQ ID NO: 10336 - DNA, 20 bp, Artificial Sequence
  Description of Artificial Sequence: Synthetic oligonucleotide
  Target: SOD1; (+) strand; PAM type: NRG; PAM sequence: GAG
tatggaaaagggtgtgcgtg

SEQ ID NO: 10337 - DNA, 20 bp, Artificial Sequence
  Description of Artificial Sequence: Synthetic oligonucleotide
  Target: SOD1; (+) strand; PAM type: NRG; PAM sequence: AAG
aaagggtgtgcgtggagaaa

SEQ ID NO: 10338 - DNA, 20 bp, Artificial Sequence
  Description of Artificial Sequence: Synthetic oligonucleotide
  Target: SOD1; (+) strand; PAM type: NRG; PAM sequence: AAG
ggtgtgcgtggagaaaaagc

SEQ ID NO: 10339 - DNA, 20 bp, Artificial Sequence
  Description of Artificial Sequence: Synthetic oligonucleotide
  Target: SOD1; (+) strand; PAM type: NRG; PAM sequence: AGG
gtgtgcgtggagaaaaagca

SEQ ID NO: 10340 - DNA, 20 bp, Artificial Sequence
  Description of Artificial Sequence: Synthetic oligonucleotide
  Target: SOD1; (+) strand; PAM type: NRG; PAM sequence: GGG
tgtgcgtggagaaaaagcaa

SEQ ID NO: 10341 - DNA, 20 bp, Artificial Sequence
  Description of Artificial Sequence: Synthetic oligonucleotide
  Target: SOD1; (+) strand; PAM type: NRG; PAM sequence: GGG
gtgcgtggagaaaaagcaag

SEQ ID NO: 10342 - DNA, 20 bp, Artificial Sequence
  Description of Artificial Sequence: Synthetic oligonucleotide
  Target: SOD1; (+) strand; PAM type: NRG; PAM sequence: CAG
ggagaaaaagcaaggggctc

SEQ ID NO: 10343 - DNA, 20 bp, Artificial Sequence
  Description of Artificial Sequence: Synthetic oligonucleotide
  Target: SOD1; (+) strand; PAM type: NRG; PAM sequence: GAG
agaaaaagcaaggggctcca

SEQ ID NO: 10344 - DNA, 20 bp, Artificial Sequence
  Description of Artificial Sequence: Synthetic oligonucleotide
  Target: SOD1; (+) strand; PAM type: NRG; PAM sequence: TAG
aagcaaggggctccagagtg

SEQ ID NO: 10345 - DNA, 20 bp, Artificial Sequence
  Description of Artificial Sequence: Synthetic oligonucleotide
  Target: SOD1; (+) strand; PAM type: NRG; PAM sequence: AGG
agcaaggggctccagagtgt

SEQ ID NO: 10346 - DNA, 20 bp, Artificial Sequence
  Description of Artificial Sequence: Synthetic oligonucleotide
  Target: SOD1; (+) strand; PAM type: NRG; PAM sequence: GAG
ggggctccagagtgtaggat

SEQ ID NO: 10347 - DNA, 20 bp, Artificial Sequence
  Description of Artificial Sequence: Synthetic oligonucleotide
  Target: SOD1; (+) strand; PAM type: NRG; PAM sequence: TGG
aggatgagacatacaccttt

SEQ ID NO: 10348 - DNA, 20 bp, Artificial Sequence
  Description of Artificial Sequence: Synthetic oligonucleotide
  Target: SOD1; (+) strand; PAM type: NRG; PAM sequence: GGG
ggatgagacatacacctttt

SEQ ID NO: 10349 - DNA, 20 bp, Artificial Sequence
  Description of Artificial Sequence: Synthetic oligonucleotide
  Target: SOD1; (+) strand; PAM type: NRG; PAM sequence: AAG
catacaccttttgggttaaa

SEQ ID NO: 10350 - DNA, 20 bp, Artificial Sequence
  Description of Artificial Sequence: Synthetic oligonucleotide
  Target: SOD1; (+) strand; PAM type: NRG; PAM sequence: AGG
atacaccttttgggttaaaa

SEQ ID NO: 10351 - DNA, 20 bp, Artificial Sequence
  Description of Artificial Sequence: Synthetic oligonucleotide
  Target: SOD1; (+) strand; PAM type: NRG; PAM sequence: GAG
ccttttgggttaaaaaggct

SEQ ID NO: 10352 - DNA, 20 bp, Artificial Sequence
  Description of Artificial Sequence: Synthetic oligonucleotide
  Target: SOD1; (+) strand; PAM type: NRG; PAM sequence: AGG
cttttgggttaaaaaggctg

SEQ ID NO: 10353 - DNA, 20 bp, Artificial Sequence
  Description of Artificial Sequence: Synthetic oligonucleotide
  Target: SOD1; (+) strand; PAM type: NRG; PAM sequence: CAG
ttgggttaaaaaggctgagg

SEQ ID NO: 10354 - DNA, 20 bp, Artificial Sequence
  Description of Artificial Sequence: Synthetic oligonucleotide
  Target: SOD1; (+) strand; PAM type: NRG; PAM sequence: AGG
tgggttaaaaaggctgaggc

SEQ ID NO: 10355 - DNA, 20 bp, Artificial Sequence
  Description of Artificial Sequence: Synthetic oligonucleotide
  Target: SOD1; (+) strand; PAM type: NRG; PAM sequence: GAG
ggttaaaaaggctgaggcag

SEQ ID NO: 10356 - DNA, 20 bp, Artificial Sequence
  Description of Artificial Sequence: Synthetic oligonucleotide
  Target: SOD1; (+) strand; PAM type: NRG; PAM sequence: TGG
aaaaggctgaggcaggagaa

SEQ ID NO: 10357 - DNA, 20 bp, Artificial Sequence
  Description of Artificial Sequence: Synthetic oligonucleotide
  Target: SOD1; (+) strand; PAM type: NRG; PAM sequence: CGG
gcaggagaatggcgtgaacc

SEQ ID NO: 10358 - DNA, 20 bp, Artificial Sequence
  Description of Artificial Sequence: Synthetic oligonucleotide
  Target: SOD1; (+) strand; PAM type: NRG; PAM sequence: GGG
caggagaatggcgtgaaccc

SEQ ID NO: 10359 - DNA, 20 bp, Artificial Sequence
  Description of Artificial Sequence: Synthetic oligonucleotide
  Target: SOD1; (+) strand; PAM type: NRG; PAM sequence: GAG
ggagaatggcgtgaacccgg

SEQ ID NO: 10360 - DNA, 20 bp, Artificial Sequence
  Description of Artificial Sequence: Synthetic oligonucleotide
  Target: SOD1; (+) strand; PAM type: NRG; PAM sequence: AGG
gagaatggcgtgaacccggg

SEQ ID NO: 10361 - DNA, 20 bp, Artificial Sequence
  Description of Artificial Sequence: Synthetic oligonucleotide
  Target: SOD1; (+) strand; PAM type: NRG; PAM sequence: CGG
aatggcgtgaacccgggagg

SEQ ID NO: 10362 - DNA, 20 bp, Artificial Sequence
  Description of Artificial Sequence: Synthetic oligonucleotide
  Target: SOD1; (+) strand; PAM type: NRG; PAM sequence: GAG
tggcgtgaacccgggaggcg

SEQ ID NO: 10363 - DNA, 20 bp, Artificial Sequence
  Description of Artificial Sequence: Synthetic oligonucleotide
  Target: SOD1; (+) strand; PAM type: NRG; PAM sequence: CAG
aacccgggaggcggagcttg

SEQ ID NO: 10364 - DNA, 20 bp, Artificial Sequence
  Description of Artificial Sequence: Synthetic oligonucleotide
  Target: SOD1; (+) strand; PAM type: NRG; PAM sequence: GAG
cgggaggcggagcttgcagt

SEQ ID NO: 10365 - DNA, 20 bp, Artificial Sequence
  Description of Artificial Sequence: Synthetic oligonucleotide
  Target: SOD1; (+) strand; PAM type: NRG; PAM sequence: GAG
ggcggagcttgcagtgagct

SEQ ID NO: 10366 - DNA, 20 bp, Artificial Sequence
  Description of Artificial Sequence: Synthetic oligonucleotide
  Target: SOD1; (+) strand; PAM type: NRG; PAM sequence: CAG
gagatcatgccactgcactc

SEQ ID NO: 10367 - DNA, 20 bp, Artificial Sequence
  Description of Artificial Sequence: Synthetic oligonucleotide
  Target: SOD1; (+) strand; PAM type: NRG; PAM sequence: TGG
catgccactgcactccagcc

SEQ ID NO: 10368 - DNA, 20 bp, Artificial Sequence
  Description of Artificial Sequence: Synthetic oligonucleotide
  Target: SOD1; (+) strand; PAM type: NRG; PAM sequence: GGG
atgccactgcactccagcct

SEQ ID NO: 10369 - DNA, 20 bp, Artificial Sequence
  Description of Artificial Sequence: Synthetic oligonucleotide
  Target: SOD1; (+) strand; PAM type: NRG; PAM sequence: CAG
ctgcactccagcctgggcga

SEQ ID NO: 10370 - DNA, 20 bp, Artificial Sequence
  Description of Artificial Sequence: Synthetic oligonucleotide
  Target: SOD1; (+) strand; PAM type: NRG; PAM sequence: GAG
gcactccagcctgggcgaca

SEQ ID NO: 10371 - DNA, 20 bp, Artificial Sequence
  Description of Artificial Sequence: Synthetic oligonucleotide
  Target: SOD1; (+) strand; PAM type: NRG; PAM sequence: GAG
tccagcctgggcgacagagc

SEQ ID NO: 10372 - DNA, 20 bp, Artificial Sequence
  Description of Artificial Sequence: Synthetic oligonucleotide
  Target: SOD1; (+) strand; PAM type: NRG; PAM sequence: AAG
tacaaatataacctattcaa

SEQ ID NO: 10373 - DNA, 20 bp, Artificial Sequence
  Description of Artificial Sequence: Synthetic oligonucleotide
  Target: SOD1; (+) strand; PAM type: NRG; PAM sequence: TAG
aaaagtatttactacataaa

SEQ ID NO: 10374 - DNA, 20 bp, Artificial Sequence
  Description of Artificial Sequence: Synthetic oligonucleotide
  Target: SOD1; (+) strand; PAM type: NRG; PAM sequence: AGG
aaagtatttactacataaat

SEQ ID NO: 10375 - DNA, 20 bp, Artificial Sequence
  Description of Artificial Sequence: Synthetic oligonucleotide
  Target: SOD1; (+) strand; PAM type: NRG; PAM sequence: TAG
acattacctatttactgtaa

SEQ ID NO: 10376 - DNA, 20 bp, Artificial Sequence
  Description of Artificial Sequence: Synthetic oligonucleotide
  Target: SOD1; (+) strand; PAM type: NRG; PAM sequence: AAG
cctatttactgtaatagtca

SEQ ID NO: 10377 - DNA, 20 bp, Artificial Sequence
  Description of Artificial Sequence: Synthetic oligonucleotide
  Target: SOD1; (+) strand; PAM type: NRG; PAM sequence: AAG
tgtaatagtcaaagcctatg

SEQ ID NO: 10378 - DNA, 20 bp, Artificial Sequence
  Description of Artificial Sequence: Synthetic oligonucleotide
  Target: SOD1; (+) strand; PAM type: NRG; PAM sequence: TAG
aagtatctaacactgatgtg

SEQ ID NO: 10379 - DNA, 20 bp, Artificial Sequence
  Description of Artificial Sequence: Synthetic oligonucleotide
  Target: SOD1; (+) strand; PAM type: NRG; PAM sequence: AGG
agtatctaacactgatgtgt

SEQ ID NO: 10380 - DNA, 20 bp, Artificial Sequence
  Description of Artificial Sequence: Synthetic oligonucleotide
  Target: SOD1; (+) strand; PAM type: NRG; PAM sequence: TAG
cactttgcttgccactctat

SEQ ID NO: 10381 - DNA, 20 bp, Artificial Sequence
  Description of Artificial Sequence: Synthetic oligonucleotide
  Target: SOD1; (+) strand; PAM type: NRG; PAM sequence: AGG
actttgcttgccactctatt

SEQ ID NO: 10382 - DNA, 20 bp, Artificial Sequence
  Description of Artificial Sequence: Synthetic oligonucleotide
  Target: SOD1; (+) strand; PAM type: NRG; PAM sequence: AAG
ttttatgttatttaatcatg

SEQ ID NO: 10383 - DNA, 20 bp, Artificial Sequence
  Description of Artificial Sequence: Synthetic oligonucleotide
  Target: SOD1; (+) strand; PAM type: NRG; PAM sequence: TGG
tgttatttaatcatgaagcc

SEQ ID NO: 10384 - DNA, 20 bp, Artificial Sequence
  Description of Artificial Sequence: Synthetic oligonucleotide
  Target: SOD1; (+) strand; PAM type: NRG; PAM sequence: CAG
ttaatcatgaagcctggcca

SEQ ID NO: 10385 - DNA, 20 bp, Artificial Sequence
  Description of Artificial Sequence: Synthetic oligonucleotide
  Target: SOD1; (+) strand; PAM type: NRG; PAM sequence: AGG
taatcatgaagcctggccac

SEQ ID NO: 10386 - DNA, 20 bp, Artificial Sequence
  Description of Artificial Sequence: Synthetic oligonucleotide
  Target: SOD1; (+) strand; PAM type: NRG; PAM sequence: GGG
aatcatgaagcctggccaca

SEQ ID NO: 10387 - DNA, 20 bp, Artificial Sequence
  Description of Artificial Sequence: Synthetic oligonucleotide
  Target: SOD1; (+) strand; PAM type: NRG; PAM sequence: GAG
ccacagggtgcttgtgcatt

SEQ ID NO: 10388 - DNA, 20 bp, Artificial Sequence
  Description of Artificial Sequence: Synthetic oligonucleotide
  Target: SOD1; (+) strand; PAM type: NRG; PAM sequence: TGG
gggtgcttgtgcattgagtg

SEQ ID NO: 10389 - DNA, 20 bp, Artificial Sequence
  Description of Artificial Sequence: Synthetic oligonucleotide
  Target: SOD1; (+) strand; PAM type: NRG; PAM sequence: GGG
ggtgcttgtgcattgagtgt

SEQ ID NO: 10390 - DNA, 20 bp, Artificial Sequence
  Description of Artificial Sequence: Synthetic oligonucleotide
  Target: SOD1; (+) strand; PAM type: NRG; PAM sequence: AAG
tgtgcattgagtgtgggaac

SEQ ID NO: 10391 - DNA, 20 bp, Artificial Sequence
  Description of Artificial Sequence: Synthetic oligonucleotide
  Target: SOD1; (+) strand; PAM type: NRG; PAM sequence: GAG
aagattaccatctccctttt

SEQ ID NO: 10392 - DNA, 20 bp, Artificial Sequence
  Description of Artificial Sequence: Synthetic oligonucleotide
  Target: SOD1; (+) strand; PAM type: NRG; PAM sequence: AGG
agattaccatctcccttttg

SEQ ID NO: 10393 - DNA, 20 bp, Artificial Sequence
  Description of Artificial Sequence: Synthetic oligonucleotide
  Target: SOD1; (+) strand; PAM type: NRG; PAM sequence: CAG
ccatctcccttttgaggaca

SEQ ID NO: 10394 - DNA, 20 bp, Artificial Sequence
  Description of Artificial Sequence: Synthetic oligonucleotide
  Target: SOD1; (+) strand; PAM type: NRG; PAM sequence: AGG
catctcccttttgaggacac

SEQ ID NO: 10395 - DNA, 20 bp, Artificial Sequence
  Description of Artificial Sequence: Synthetic oligonucleotide
  Target: SOD1; (+) strand; PAM type: NRG; PAM sequence: TAG
cccttttgaggacacaggcc

SEQ ID NO: 10396 - DNA, 20 bp, Artificial Sequence
  Description of Artificial Sequence: Synthetic oligonucleotide
  Target: SOD1; (+) strand; PAM type: NRG; PAM sequence: GAG
cttttgaggacacaggccta

SEQ ID NO: 10397 - DNA, 20 bp, Artificial Sequence
  Description of Artificial Sequence: Synthetic oligonucleotide
  Target: SOD1; (+) strand; PAM type: NRG; PAM sequence: CAG
ttgaggacacaggcctagag

SEQ ID NO: 10398 - DNA, 20 bp, Artificial Sequence
  Description of Artificial Sequence: Synthetic oligonucleotide
  Target: SOD1; (+) strand; PAM type: NRG; PAM sequence: AAG
gacacaggcctagagcagtt

SEQ ID NO: 10399 - DNA, 20 bp, Artificial Sequence
  Description of Artificial Sequence: Synthetic oligonucleotide
  Target: SOD1; (+) strand; PAM type: NRG; PAM sequence: CAG
acaggcctagagcagttaag

SEQ ID NO: 10400 - DNA, 20 bp, Artificial Sequence
  Description of Artificial Sequence: Synthetic oligonucleotide
  Target: SOD1; (+) strand; PAM type: NRG; PAM sequence: TGG
agagcagttaagcagcttgc

SEQ ID NO: 10401 - DNA, 20 bp, Artificial Sequence
  Description of Artificial Sequence: Synthetic oligonucleotide
  Target: SOD1; (+) strand; PAM type: NRG; PAM sequence: GAG
agcagttaagcagcttgctg

SEQ ID NO: 10402 - DNA, 20 bp, Artificial Sequence
  Description of Artificial Sequence: Synthetic oligonucleotide
  Target: SOD1; (+) strand; PAM type: NRG; PAM sequence: AGG
gcagttaagcagcttgctgg

SEQ ID NO: 10403 - DNA, 20 bp, Artificial Sequence
  Description of Artificial Sequence: Synthetic oligonucleotide
  Target: SOD1; (+) strand; PAM type: NRG; PAM sequence: TGG
gcagcttgctggaggttcac

SEQ ID NO: 10404 - DNA, 20 bp, Artificial Sequence
  Description of Artificial Sequence: Synthetic oligonucleotide
  Target: SOD1; (+) strand; PAM type: NRG; PAM sequence: TAG
cttgctggaggttcactggc

SEQ ID NO: 10405 - DNA, 20 bp, Artificial Sequence
  Description of Artificial Sequence: Synthetic oligonucleotide
  Target: SOD1; (+) strand; PAM type: NRG; PAM sequence: AAG
ctggaggttcactggctaga

SEQ ID NO: 10406 - DNA, 20 bp, Artificial Sequence
  Description of Artificial Sequence: Synthetic oligonucleotide
  Target: SOD1; (+) strand; PAM type: NRG; PAM sequence: TGG
gaggttcactggctagaaag

SEQ ID NO: 10407 - DNA, 20 bp, Artificial Sequence
  Description of Artificial Sequence: Synthetic oligonucleotide
  Target: SOD1; (+) strand; PAM type: NRG; PAM sequence: CAG
ttcactggctagaaagtggt

SEQ ID NO: 10408 - DNA, 20 bp, Artificial Sequence
  Description of Artificial Sequence: Synthetic oligonucleotide
  Target: SOD1; (+) strand; PAM type: NRG; PAM sequence: TGG
tggctagaaagtggtcagcc

SEQ ID NO: 10409 - DNA, 20 bp, Artificial Sequence
  Description of Artificial Sequence: Synthetic oligonucleotide
  Target: SOD1; (+) strand; PAM type: NRG; PAM sequence: GGG
ggctagaaagtggtcagcct

SEQ ID NO: 10410 - DNA, 20 bp, Artificial Sequence
  Description of Artificial Sequence: Synthetic oligonucleotide
  Target: SOD1; (+) strand; PAM type: NRG; PAM sequence: TGG
aaagtggtcagcctgggatt

SEQ ID NO: 10411 - DNA, 20 bp, Artificial Sequence
  Description of Artificial Sequence: Synthetic oligonucleotide
  Target: SOD1; (+) strand; PAM type: NRG; PAM sequence: CAG
gtcagcctgggatttggaca

SEQ ID NO: 10412 - DNA, 20 bp, Artificial Sequence
  Description of Artificial Sequence: Synthetic oligonucleotide
  Target: SOD1; (+) strand; PAM type: NRG; PAM sequence: AAG
acacagatttttccactccc

SEQ ID NO: 10413 - DNA, 20 bp, Artificial Sequence
  Description of Artificial Sequence: Synthetic oligonucleotide
  Target: SOD1; (+) strand; PAM type: NRG; PAM sequence: TGG
gatttttccactcccaagtc

SEQ ID NO: 10414 - DNA, 20 bp, Artificial Sequence
  Description of Artificial Sequence: Synthetic oligonucleotide
  Target: SOD1; (+) strand; PAM type: NRG; PAM sequence: GAG
gctgctttttacttcactgt

SEQ ID NO: 10415 - DNA, 20 bp, Artificial Sequence
  Description of Artificial Sequence: Synthetic oligonucleotide
  Target: SOD1; (+) strand; PAM type: NRG; PAM sequence: AGG
ctgctttttacttcactgtg

SEQ ID NO: 10416 - DNA, 20 bp, Artificial Sequence
  Description of Artificial Sequence: Synthetic oligonucleotide
  Target: SOD1; (+) strand; PAM type: NRG; PAM sequence: GGG
tgctttttacttcactgtga

SEQ ID NO: 10417 - DNA, 20 bp, Artificial Sequence
  Description of Artificial Sequence: Synthetic oligonucleotide
  Target: SOD1; (+) strand; PAM type: NRG; PAM sequence: GGG
gctttttacttcactgtgag

SEQ ID NO: 10418 - DNA, 20 bp, Artificial Sequence
  Description of Artificial Sequence: Synthetic oligonucleotide
  Target: SOD1; (+) strand; PAM type: NRG; PAM sequence: AAG
ttacttcactgtgaggggta

SEQ ID NO: 10419 - DNA, 20 bp, Artificial Sequence
  Description of Artificial Sequence: Synthetic oligonucleotide
  Target: SOD1; (+) strand; PAM type: NRG; PAM sequence: AGG
tacttcactgtgaggggtaa

SEQ ID NO: 10420 - DNA, 20 bp, Artificial Sequence
  Description of Artificial Sequence: Synthetic oligonucleotide
  Target: SOD1; (+) strand; PAM type: NRG; PAM sequence: CAG
tgtgaggggtaaaggtaaat

SEQ ID NO: 10421 - DNA, 20 bp, Artificial Sequence
  Description of Artificial Sequence: Synthetic oligonucleotide
  Target: SOD1; (+) strand; PAM type: NRG; PAM sequence: CAG
aatcagctgttttctttgtt

SEQ ID NO: 10422 - DNA, 20 bp, Artificial Sequence
  Description of Artificial Sequence: Synthetic oligonucleotide
  Target: SOD1; (+) strand; PAM type: NRG; PAM sequence: AAG
ccaactttgcacttttctta

SEQ ID NO: 10423 - DNA, 20 bp, Artificial Sequence
  Description of Artificial Sequence: Synthetic oligonucleotide
  Target: SOD1; (+) strand; PAM type: NRG; PAM sequence: AGG
caactttgcacttttcttaa

SEQ ID NO: 10424 - DNA, 20 bp, Artificial Sequence
  Description of Artificial Sequence: Synthetic oligonucleotide
  Target: SOD1; (+) strand; PAM type: NRG; PAM sequence: AAG
tttgcacttttcttaaagga

SEQ ID NO: 10425 - DNA, 20 bp, Artificial Sequence
  Description of Artificial Sequence: Synthetic oligonucleotide
  Target: SOD1; (+) strand; PAM type: NRG; PAM sequence: TGG
cttttcttaaaggaaagtaa

SEQ ID NO: 10426 - DNA, 20 bp, Artificial Sequence
  Description of Artificial Sequence: Synthetic oligonucleotide
  Target: SOD1; (+) strand; PAM type: NRG; PAM sequence: CAG
cttaaaggaaagtaatggac

SEQ ID NO: 10427 - DNA, 20 bp, Artificial Sequence
  Description of Artificial Sequence: Synthetic oligonucleotide
  Target: SOD1; (+) strand; PAM type: NRG; PAM sequence: AAG
aggaaagtaatggaccagtg

SEQ ID NO: 10428 - DNA, 20 bp, Artificial Sequence
  Description of Artificial Sequence: Synthetic oligonucleotide
  Target: SOD1; (+) strand; PAM type: NRG; PAM sequence: AGG
ggaaagtaatggaccagtga

SEQ ID NO: 10429 - DNA, 20 bp, Artificial Sequence
  Description of Artificial Sequence: Synthetic oligonucleotide
  Target: SOD1; (+) strand; PAM type: NRG; PAM sequence: TGG
gtaatggaccagtgaaggtg

SEQ ID NO: 10430 - DNA, 20 bp, Artificial Sequence
  Description of Artificial Sequence: Synthetic oligonucleotide
  Target: SOD1; (+) strand; PAM type: NRG; PAM sequence: GGG
taatggaccagtgaaggtgt

SEQ ID NO: 10431 - DNA, 20 bp, Artificial Sequence
  Description of Artificial Sequence: Synthetic oligonucleotide
  Target: SOD1; (+) strand; PAM type: NRG; PAM sequence: GGG
aatggaccagtgaaggtgtg

SEQ ID NO: 10432 - DNA, 20 bp, Artificial Sequence
  Description of Artificial Sequence: Synthetic oligonucleotide
  Target: SOD1; (+) strand; PAM type: NRG; PAM sequence: AAG
ggaccagtgaaggtgtgggg

SEQ ID NO: 10433 - DNA, 20 bp, Artificial Sequence
  Description of Artificial Sequence: Synthetic oligonucleotide
  Target: SOD1; (+) strand; PAM type: NRG; PAM sequence: AAG
gaaggtgtggggaagcatta

SEQ ID NO: 10434 - DNA, 20 bp, Artificial Sequence
  Description of Artificial Sequence: Synthetic oligonucleotide
  Target: SOD1; (+) strand; PAM type: NRG; PAM sequence: AGG
aaggtgtggggaagcattaa

SEQ ID NO: 10435 - DNA, 20 bp, Artificial Sequence
  Description of Artificial Sequence: Synthetic oligonucleotide
  Target: SOD1; (+) strand; PAM type: NRG; PAM sequence: AAG
aagcattaaaggactgactg

SEQ ID NO: 10436 - DNA, 20 bp, Artificial Sequence
  Description of Artificial Sequence: Synthetic oligonucleotide
  Target: SOD1; (+) strand; PAM type: NRG; PAM sequence: AGG
agcattaaaggactgactga

SEQ ID NO: 10437 - DNA, 20 bp, Artificial Sequence
  Description of Artificial Sequence: Synthetic oligonucleotide
  Target: SOD1; (+) strand; PAM type: NRG; PAM sequence: TGG
ggactgactgaaggcctgca

SEQ ID NO: 10438 - DNA, 20 bp, Artificial Sequence
  Description of Artificial Sequence: Synthetic oligonucleotide
  Target: SOD1; (+) strand; PAM type: NRG; PAM sequence: GAG
tgcatggattccatgttcat

SEQ ID NO: 10439 - DNA, 20 bp, Artificial Sequence
  Description of Artificial Sequence: Synthetic oligonucleotide
  Target: SOD1; (+) strand; PAM type: NRG; PAM sequence: TGG
ggattccatgttcatgagtt

SEQ ID NO: 10440 - DNA, 20 bp, Artificial Sequence
  Description of Artificial Sequence: Synthetic oligonucleotide
  Target: SOD1; (+) strand; PAM type: NRG; PAM sequence: GAG
attccatgttcatgagtttg

SEQ ID NO: 10441 - DNA, 20 bp, Artificial Sequence
  Description of Artificial Sequence: Synthetic oligonucleotide
  Target: SOD1; (+) strand; PAM type: NRG; PAM sequence: CAG
tcatgagtttggagataata

SEQ ID NO: 10442 - DNA, 20 bp, Artificial Sequence
  Description of Artificial Sequence: Synthetic oligonucleotide
  Target: SOD1; (+) strand; PAM type: NRG; PAM sequence: CAG
tgagtttggagataatacag

SEQ ID NO: 10443 - DNA, 20 bp, Artificial Sequence
  Description of Artificial Sequence: Synthetic oligonucleotide
  Target: SOD1; (+) strand; PAM type: NRG; PAM sequence: AGG
gagtttggagataatacagc

SEQ ID NO: 10444 - DNA, 20 bp, Artificial Sequence
  Description of Artificial Sequence: Synthetic oligonucleotide
  Target: SOD1; (+) strand; PAM type: NRG; PAM sequence: TGG
tttggagataatacagcagg

SEQ ID NO: 10445 - DNA, 20 bp, Artificial Sequence
  Description of Artificial Sequence: Synthetic oligonucleotide
  Target: SOD1; (+) strand; PAM type: NRG; PAM sequence: GGG
ttggagataatacagcaggt

SEQ ID NO: 10446 - DNA, 20 bp, Artificial Sequence
  Description of Artificial Sequence: Synthetic oligonucleotide
  Target: SOD1; (+) strand; PAM type: NRG; PAM sequence: TGG
aggtgggtgttgtgctgtgc

SEQ ID NO: 10447 - DNA, 20 bp, Artificial Sequence
  Description of Artificial Sequence: Synthetic oligonucleotide
  Target: SOD1; (+) strand; PAM type: NRG; PAM sequence: TAG
tgacccatacttgttcaccc

SEQ ID NO: 10448 - DNA, 20 bp, Artificial Sequence
  Description of Artificial Sequence: Synthetic oligonucleotide
  Target: SOD1; (+) strand; PAM type: NRG; PAM sequence: TAG
ccatacttgttcaccctagt

SEQ ID NO: 10449 - DNA, 20 bp, Artificial Sequence
  Description of Artificial Sequence: Synthetic oligonucleotide
  Target: SOD1; (+) strand; PAM type: NRG; PAM sequence: CAG
gttcaccctagttagataaa

SEQ ID NO: 10450 - DNA, 20 bp, Artificial Sequence
  Description of Artificial Sequence: Synthetic oligonucleotide
  Target: SOD1; (+) strand; PAM type: NRG; PAM sequence: TAG
caccctagttagataaacag

SEQ ID NO: 10451 - DNA, 20 bp, Artificial Sequence
  Description of Artificial Sequence: Synthetic oligonucleotide
  Target: SOD1; (+) strand; PAM type: NRG; PAM sequence: GAG
ccctagttagataaacagta

SEQ ID NO: 10452 - DNA, 20 bp, Artificial Sequence
  Description of Artificial Sequence: Synthetic oligonucleotide
  Target: SOD1; (+) strand; PAM type: NRG; PAM sequence: TAG
tagttagataaacagtagag

SEQ ID NO: 10453 - DNA, 20 bp, Artificial Sequence
  Description of Artificial Sequence: Synthetic oligonucleotide
  Target: SOD1; (+) strand; PAM type: NRG; PAM sequence: GAG
ctcaacttgtttttgttttt

SEQ ID NO: 10454 - DNA, 20 bp, Artificial Sequence
  Description of Artificial Sequence: Synthetic oligonucleotide
  Target: SOD1; (+) strand; PAM type: NRG; PAM sequence: AAG
acttgtttttgtttttgaga

SEQ ID NO: 10455 - DNA, 20 bp, Artificial Sequence
  Description of Artificial Sequence: Synthetic oligonucleotide
  Target: SOD1; (+) strand; PAM type: NRG; PAM sequence: AGG
cttgtttttgtttttgagaa

SEQ ID NO: 10456 - DNA, 20 bp, Artificial Sequence
  Description of Artificial Sequence: Synthetic oligonucleotide
  Target: SOD1; (+) strand; PAM type: NRG; PAM sequence: GGG
ttgtttttgtttttgagaaa

SEQ ID NO: 10457 - DNA, 20 bp, Artificial Sequence
  Description of Artificial Sequence: Synthetic oligonucleotide
  Target: SOD1; (+) strand; PAM type: NRG; PAM sequence: CAG
aagggtcttgctctgtcgct

SEQ ID NO: 10458 - DNA, 20 bp, Artificial Sequence
  Description of Artificial Sequence: Synthetic oligonucleotide
  Target: SOD1; (+) strand; PAM type: NRG; PAM sequence: AGG
agggtcttgctctgtcgctc

SEQ ID NO: 10459 - DNA, 20 bp, Artificial Sequence
  Description of Artificial Sequence: Synthetic oligonucleotide
  Target: SOD1; (+) strand; PAM type: NRG; PAM sequence: TGG
tcttgctctgtcgctcaggc

SEQ ID NO: 10460 - DNA, 20 bp, Artificial Sequence
  Description of Artificial Sequence: Synthetic oligonucleotide
  Target: SOD1; (+) strand; PAM type: NRG; PAM sequence: GAG
ttgctctgtcgctcaggctg

SEQ ID NO: 10461 - DNA, 20 bp, Artificial Sequence
  Description of Artificial Sequence: Synthetic oligonucleotide
  Target: SOD1; (+) strand; PAM type: NRG; PAM sequence: CAG
ctgtcgctcaggctggagtg

SEQ ID NO: 10462 - DNA, 20 bp, Artificial Sequence
  Description of Artificial Sequence: Synthetic oligonucleotide
  Target: SOD1; (+) strand; PAM type: NRG; PAM sequence: TGG
tcgctcaggctggagtgcag

SEQ ID NO: 10463 - DNA, 20 bp, Artificial Sequence
  Description of Artificial Sequence: Synthetic oligonucleotide
  Target: SOD1; (+) strand; PAM type: NRG; PAM sequence: TGG
gcagtggcgctgtgcgatca

SEQ ID NO: 10464 - DNA, 20 bp, Artificial Sequence
  Description of Artificial Sequence: Synthetic oligonucleotide
  Target: SOD1; (+) strand; PAM type: NRG; PAM sequence: TAG
tgtgcgatcatggctgacct

SEQ ID NO: 10465 - DNA, 20 bp, Artificial Sequence
  Description of Artificial Sequence: Synthetic oligonucleotide
  Target: SOD1; (+) strand; PAM type: NRG; PAM sequence: CAG
tgaccttagccttgacctcc

SEQ ID NO: 10466 - DNA, 20 bp, Artificial Sequence
  Description of Artificial Sequence: Synthetic oligonucleotide
  Target: SOD1; (+) strand; PAM type: NRG; PAM sequence: AGG
gaccttagccttgacctccc

SEQ ID NO: 10467 - DNA, 20 bp, Artificial Sequence
  Description of Artificial Sequence: Synthetic oligonucleotide
  Target: SOD1; (+) strand; PAM type: NRG; PAM sequence: TGG
ctccattgatcctcatgcct

SEQ ID NO: 10468 - DNA, 20 bp, Artificial Sequence
  Description of Artificial Sequence: Synthetic oligonucleotide
  Target: SOD1; (+) strand; PAM type: NRG; PAM sequence: TAG
gatcctcatgccttggcccg

SEQ ID NO: 10469 - DNA, 20 bp, Artificial Sequence
  Description of Artificial Sequence: Synthetic oligonucleotide
  Target: SOD1; (+) strand; PAM type: NRG; PAM sequence: TGG
ctcatgccttggcccgtagc

SEQ ID NO: 10470 - DNA, 20 bp, Artificial Sequence
  Description of Artificial Sequence: Synthetic oligonucleotide
  Target: SOD1; (+) strand; PAM type: NRG; PAM sequence: GGG
tcatgccttggcccgtagct

SEQ ID NO: 10471 - DNA, 20 bp, Artificial Sequence
  Description of Artificial Sequence: Synthetic oligonucleotide
  Target: SOD1; (+) strand; PAM type: NRG; PAM sequence: CAG
ttggcccgtagctgggacta

SEQ ID NO: 10472 - DNA, 20 bp, Artificial Sequence
  Description of Artificial Sequence: Synthetic oligonucleotide
  Target: SOD1; (+) strand; PAM type: NRG; PAM sequence: AGG
tggcccgtagctgggactac

SEQ ID NO: 10473 - DNA, 20 bp, Artificial Sequence
  Description of Artificial Sequence: Synthetic oligonucleotide
  Target: SOD1; (+) strand; PAM type: NRG; PAM sequence: TGG
caggtacacaccaccacgcc

SEQ ID NO: 10474 - DNA, 20 bp, Artificial Sequence
  Description of Artificial Sequence: Synthetic oligonucleotide
  Target: SOD1; (+) strand; PAM type: NRG; PAM sequence: TAG
ctaatttttgtatttttttc

SEQ ID NO: 10475 - DNA, 20 bp, Artificial Sequence
  Description of Artificial Sequence: Synthetic oligonucleotide
  Target: SOD1; (+) strand; PAM type: NRG; PAM sequence: GAG
aatttttgtatttttttcta

SEQ ID NO: 10476 - DNA, 20 bp, Artificial Sequence
  Description of Artificial Sequence: Synthetic oligonucleotide
  Target: SOD1; (+) strand; PAM type: NRG; PAM sequence: AGG
atttttgtatttttttctag

SEQ ID NO: 10477 - DNA, 20 bp, Artificial Sequence
  Description of Artificial Sequence: Synthetic oligonucleotide
  Target: SOD1; (+) strand; PAM type: NRG; PAM sequence: TGG
tttgtatttttttctagagg

SEQ ID NO: 10478 - DNA, 20 bp, Artificial Sequence
  Description of Artificial Sequence: Synthetic oligonucleotide
  Target: SOD1; (+) strand; PAM type: NRG; PAM sequence: GGG
ttgtatttttttctagaggt

SEQ ID NO: 10479 - DNA, 20 bp, Artificial Sequence
  Description of Artificial Sequence: Synthetic oligonucleotide
  Target: SOD1; (+) strand; PAM type: NRG; PAM sequence: GGG
tgtatttttttctagaggtg

SEQ ID NO: 10480 - DNA, 20 bp, Artificial Sequence
  Description of Artificial Sequence: Synthetic oligonucleotide
  Target: SOD1; (+) strand; PAM type: NRG; PAM sequence: CAG
tggggtttcatcatgttgcc

SEQ ID NO: 10481 - DNA, 20 bp, Artificial Sequence
  Description of Artificial Sequence: Synthetic oligonucleotide
  Target: SOD1; (+) strand; PAM type: NRG; PAM sequence: AGG
ggggtttcatcatgttgccc

SEQ ID NO: 10482 - DNA, 20 bp, Artificial Sequence
  Description of Artificial Sequence: Synthetic oligonucleotide
  Target: SOD1; (+) strand; PAM type: NRG; PAM sequence: TGG
tttcatcatgttgcccaggc

SEQ ID NO: 10483 - DNA, 20 bp, Artificial Sequence
  Description of Artificial Sequence: Synthetic oligonucleotide
  Target: SOD1; (+) strand; PAM type: NRG; PAM sequence: TGG
ccaggctggtcttgaactgc

SEQ ID NO: 10484 - DNA, 20 bp, Artificial Sequence
  Description of Artificial Sequence: Synthetic oligonucleotide
  Target: SOD1; (+) strand; PAM type: NRG; PAM sequence: GGG
caggctggtcttgaactgct

SEQ ID NO: 10485 - DNA, 20 bp, Artificial Sequence
  Description of Artificial Sequence: Synthetic oligonucleotide
  Target: SOD1; (+) strand; PAM type: NRG; PAM sequence: AAG
ggtcttgaactgctgggctc

SEQ ID NO: 10486 - DNA, 20 bp, Artificial Sequence
  Description of Artificial Sequence: Synthetic oligonucleotide
  Target: SOD1; (+) strand; PAM type: NRG; PAM sequence: TGG
cttgaactgctgggctcaag

SEQ ID NO: 10487 - DNA, 20 bp, Artificial Sequence
  Description of Artificial Sequence: Synthetic oligonucleotide
  Target: SOD1; (+) strand; PAM type: NRG; PAM sequence: AAG
ctatcctcctcgacctccca

SEQ ID NO: 10488 - DNA, 20 bp, Artificial Sequence
  Description of Artificial Sequence: Synthetic oligonucleotide
  Target: SOD1; (+) strand; PAM type: NRG; PAM sequence: TGG
tcctcgacctcccaaagtgc

SEQ ID NO: 10489 - DNA, 20 bp, Artificial Sequence
  Description of Artificial Sequence: Synthetic oligonucleotide
  Target: SOD1; (+) strand; PAM type: NRG; PAM sequence: GGG
cctcgacctcccaaagtgct

SEQ ID NO: 10490 - DNA, 20 bp, Artificial Sequence
  Description of Artificial Sequence: Synthetic oligonucleotide
  Target: SOD1; (+) strand; PAM type: NRG; PAM sequence: GAG
agtgctgggattacatgtgt

SEQ ID NO: 10491 - DNA, 20 bp, Artificial Sequence
  Description of Artificial Sequence: Synthetic oligonucleotide
  Target: SOD1; (+) strand; PAM type: NRG; PAM sequence: TGG
catgtgtgagccactgtgcc

SEQ ID NO: 10492 - DNA, 20 bp, Artificial Sequence
  Description of Artificial Sequence: Synthetic oligonucleotide
  Target: SOD1; (+) strand; PAM type: NRG; PAM sequence: GGG
atgtgtgagccactgtgcct

SEQ ID NO: 10493 - DNA, 20 bp, Artificial Sequence
  Description of Artificial Sequence: Synthetic oligonucleotide
  Target: SOD1; (+) strand; PAM type: NRG; PAM sequence: AAG
cctcaacttttcttttaaaa

SEQ ID NO: 10494 - DNA, 20 bp, Artificial Sequence
  Description of Artificial Sequence: Synthetic oligonucleotide
  Target: SOD1; (+) strand; PAM type: NRG; PAM sequence: GAG
tcaacttttcttttaaaaaa

SEQ ID NO: 10495 - DNA, 20 bp, Artificial Sequence
  Description of Artificial Sequence: Synthetic oligonucleotide
  Target: SOD1; (+) strand; PAM type: NRG; PAM sequence: AGG
caacttttcttttaaaaaag

SEQ ID NO: 10496 - DNA, 20 bp, Artificial Sequence
  Description of Artificial Sequence: Synthetic oligonucleotide
  Target: SOD1; (+) strand; PAM type: NRG; PAM sequence: AAG
aggtcaactttattgtatat

SEQ ID NO: 10497 - DNA, 20 bp, Artificial Sequence
  Description of Artificial Sequence: Synthetic oligonucleotide
  Target: SOD1; (+) strand; PAM type: NRG; PAM sequence: CAG
taagcactgtgctaaaattg

SEQ ID NO: 10498 - DNA, 20 bp, Artificial Sequence
  Description of Artificial Sequence: Synthetic oligonucleotide
  Target: SOD1; (+) strand; PAM type: NRG; PAM sequence: AGG
aagcactgtgctaaaattgc

SEQ ID NO: 10499 - DNA, 20 bp, Artificial Sequence
  Description of Artificial Sequence: Synthetic oligonucleotide
  Target: SOD1; (+) strand; PAM type: NRG; PAM sequence: TGG
tgtgctaaaattgcaggaac

SEQ ID NO: 10500 - DNA, 20 bp, Artificial Sequence
  Description of Artificial Sequence: Synthetic oligonucleotide
  Target: SOD1; (+) strand; PAM type: NRG; PAM sequence: GGG
gtgctaaaattgcaggaact

SEQ ID NO: 10501 - DNA, 20 bp, Artificial Sequence
  Description of Artificial Sequence: Synthetic oligonucleotide
  Target: SOD1; (+) strand; PAM type: NRG; PAM sequence: CAG
cctgatttttgtaataatgc

SEQ ID NO: 10502 - DNA, 20 bp, Artificial Sequence
  Description of Artificial Sequence: Synthetic oligonucleotide
  Target: SOD1; (+) strand; PAM type: NRG; PAM sequence: CAG
gatttttgtaataatgccag

SEQ ID NO: 10503 - DNA, 20 bp, Artificial Sequence
  Description of Artificial Sequence: Synthetic oligonucleotide
  Target: SOD1; (+) strand; PAM type: NRG; PAM sequence: GAG
tttttgtaataatgccagca

SEQ ID NO: 10504 - DNA, 20 bp, Artificial Sequence
  Description of Artificial Sequence: Synthetic oligonucleotide
  Target: SOD1; (+) strand; PAM type: NRG; PAM sequence: AAG
aatgccagcagagtacacac

SEQ ID NO: 10505 - DNA, 20 bp, Artificial Sequence
  Description of Artificial Sequence: Synthetic oligonucleotide
  Target: SOD1; (+) strand; PAM type: NRG; PAM sequence: AAG
cagcagagtacacacaagaa

SEQ ID NO: 10506 - DNA, 20 bp, Artificial Sequence
  Description of Artificial Sequence: Synthetic oligonucleotide
  Target: SOD1; (+) strand; PAM type: NRG; PAM sequence: TAG
cacaagaaaagtaactgcac

SEQ ID NO: 10507 - DNA, 20 bp, Artificial Sequence
  Description of Artificial Sequence: Synthetic oligonucleotide
  Target: SOD1; (+) strand; PAM type: NRG; PAM sequence: AAG
agtaactgcactagattgtg

SEQ ID NO: 10508 - DNA, 20 bp, Artificial Sequence
  Description of Artificial Sequence: Synthetic oligonucleotide
  Target: SOD1; (+) strand; PAM type: NRG; PAM sequence: TGG
ctgcactagattgtgaagac

SEQ ID NO: 10509 - DNA, 20 bp, Artificial Sequence
  Description of Artificial Sequence: Synthetic oligonucleotide
  Target: SOD1; (+) strand; PAM type: NRG; PAM sequence: GGG
tgcactagattgtgaagact

SEQ ID NO: 10510 - DNA, 20 bp, Artificial Sequence
  Description of Artificial Sequence: Synthetic oligonucleotide
  Target: SOD1; (+) strand; PAM type: NRG; PAM sequence: GGG
gcactagattgtgaagactg

SEQ ID NO: 10511 - DNA, 20 bp, Artificial Sequence
  Description of Artificial Sequence: Synthetic oligonucleotide
  Target: SOD1; (+) strand; PAM type: NRG; PAM sequence: TGG
ctagattgtgaagactgggg

SEQ ID NO: 10512 - DNA, 20 bp, Artificial Sequence
  Description of Artificial Sequence: Synthetic oligonucleotide
  Target: SOD1; (+) strand; PAM type: NRG; PAM sequence: AAG
ctggggtggacctgcttctg

SEQ ID NO: 10513 - DNA, 20 bp, Artificial Sequence
  Description of Artificial Sequence: Synthetic oligonucleotide
  Target: SOD1; (+) strand; PAM type: NRG; PAM sequence: AGG
tggggtggacctgcttctga

SEQ ID NO: 10514 - DNA, 20 bp, Artificial Sequence
  Description of Artificial Sequence: Synthetic oligonucleotide
  Target: SOD1; (+) strand; PAM type: NRG; PAM sequence: CAG
tggacctgcttctgaaggtc

SEQ ID NO: 10515 - DNA, 20 bp, Artificial Sequence
  Description of Artificial Sequence: Synthetic oligonucleotide
  Target: SOD1; (+) strand; PAM type: NRG; PAM sequence: AAG
ggtccagtgccctttgtctt

SEQ ID NO: 10516 - DNA, 20 bp, Artificial Sequence
  Description of Artificial Sequence: Synthetic oligonucleotide
  Target: SOD1; (+) strand; PAM type: NRG; PAM sequence: TGG
gtgccctttgtcttaagatt

SEQ ID NO: 10517 - DNA, 20 bp, Artificial Sequence
  Description of Artificial Sequence: Synthetic oligonucleotide
  Target: SOD1; (+) strand; PAM type: NRG; PAM sequence: TAG
ctttgtcttaagatttggtg

SEQ ID NO: 10518 - DNA, 20 bp, Artificial Sequence
  Description of Artificial Sequence: Synthetic oligonucleotide
  Target: SOD1; (+) strand; PAM type: NRG; PAM sequence: TAG
gatttggtgtagtgtgtctt

SEQ ID NO: 10519 - DNA, 20 bp, Artificial Sequence
  Description of Artificial Sequence: Synthetic oligonucleotide
  Target: SOD1; (+) strand; PAM type: NRG; PAM sequence: AAG
gtgtctttagaaaccaaaaa

SEQ ID NO: 10520 - DNA, 20 bp, Artificial Sequence
  Description of Artificial Sequence: Synthetic oligonucleotide
  Target: SOD1; (+) strand; PAM type: NRG; PAM sequence: GAG
gtctttagaaaccaaaaaaa

SEQ ID NO: 10521 - DNA, 20 bp, Artificial Sequence
  Description of Artificial Sequence: Synthetic oligonucleotide
  Target: SOD1; (+) strand; PAM type: NRG; PAM sequence: AAG
tttagaaaccaaaaaaagag

SEQ ID NO: 10522 - DNA, 20 bp, Artificial Sequence
  Description of Artificial Sequence: Synthetic oligonucleotide
  Target: SOD1; (+) strand; PAM type: NRG; PAM sequence: AAG
agaaaccaaaaaaagagaag

SEQ ID NO: 10523 - DNA, 20 bp, Artificial Sequence
  Description of Artificial Sequence: Synthetic oligonucleotide
  Target: SOD1; (+) strand; PAM type: NRG; PAM sequence: AAG
aagagaagaagatcaacctt

SEQ ID NO: 10524 - DNA, 20 bp, Artificial Sequence
  Description of Artificial Sequence: Synthetic oligonucleotide
  Target: SOD1; (+) strand; PAM type: NRG; PAM sequence: TAG
aagaagatcaaccttaagat

SEQ ID NO: 10525 - DNA, 20 bp, Artificial Sequence
  Description of Artificial Sequence: Synthetic oligonucleotide
  Target: SOD1; (+) strand; PAM type: NRG; PAM sequence: TGG
cttaagattagccacaaaac

SEQ ID NO: 10526 - DNA, 20 bp, Artificial Sequence
  Description of Artificial Sequence: Synthetic oligonucleotide
  Target: SOD1; (+) strand; PAM type: NRG; PAM sequence: GGG
ttaagattagccacaaaact

SEQ ID NO: 10527 - DNA, 20 bp, Artificial Sequence
  Description of Artificial Sequence: Synthetic oligonucleotide
  Target: SOD1; (+) strand; PAM type: NRG; PAM sequence: TAG
caaaactgggctttgatacc

SEQ ID NO: 10528 - DNA, 20 bp, Artificial Sequence
  Description of Artificial Sequence: Synthetic oligonucleotide
  Target: SOD1; (+) strand; PAM type: NRG; PAM sequence: AGG
aaaactgggctttgatacct

SEQ ID NO: 10529 - DNA, 20 bp, Artificial Sequence
  Description of Artificial Sequence: Synthetic oligonucleotide
  Target: SOD1; (+) strand; PAM type: NRG; PAM sequence: TGG
tgggctttgatacctaggtg

SEQ ID NO: 10530 - DNA, 20 bp, Artificial Sequence
  Description of Artificial Sequence: Synthetic oligonucleotide
  Target: SOD1; (+) strand; PAM type: NRG; PAM sequence: AAG
tttgatacctaggtgtggaa

SEQ ID NO: 10531 - DNA, 20 bp, Artificial Sequence
  Description of Artificial Sequence: Synthetic oligonucleotide
  Target: SOD1; (+) strand; PAM type: NRG; PAM sequence: AAG
atacctaggtgtggaaaaga

SEQ ID NO: 10532 - DNA, 20 bp, Artificial Sequence
  Description of Artificial Sequence: Synthetic oligonucleotide
  Target: SOD1; (+) strand; PAM type: NRG; PAM sequence: AGG
tacctaggtgtggaaaagaa

SEQ ID NO: 10533 - DNA, 20 bp, Artificial Sequence
  Description of Artificial Sequence: Synthetic oligonucleotide
  Target: SOD1; (+) strand; PAM type: NRG; PAM sequence: GGG
acctaggtgtggaaaagaaa

SEQ ID NO: 10534 - DNA, 20 bp, Artificial Sequence
  Description of Artificial Sequence: Synthetic oligonucleotide
  Target: SOD1; (+) strand; PAM type: NRG; PAM sequence: AAG
aggtgtggaaaagaaaggga

SEQ ID NO: 10535 - DNA, 20 bp, Artificial Sequence
  Description of Artificial Sequence: Synthetic oligonucleotide
  Target: SOD1; (+) strand; PAM type: NRG; PAM sequence: GAG
gtgtggaaaagaaagggaaa

SEQ ID NO: 10536 - DNA, 20 bp, Artificial Sequence
  Description of Artificial Sequence: Synthetic oligonucleotide
  Target: SOD1; (+) strand; PAM type: NRG; PAM sequence: CAG
agagttgatgttttgtctta

SEQ ID NO: 10537 - DNA, 20 bp, Artificial Sequence
  Description of Artificial Sequence: Synthetic oligonucleotide
  Target: SOD1; (+) strand; PAM type: NRG; PAM sequence: TAG
tttgtcttacagcatcattg

SEQ ID NO: 10538 - DNA, 20 bp, Artificial Sequence
  Description of Artificial Sequence: Synthetic oligonucleotide
  Target: SOD1; (+) strand; PAM type: NRG; PAM sequence: AAG
gtcttacagcatcattgtag

SEQ ID NO: 10539 - DNA, 20 bp, Artificial Sequence
  Description of Artificial Sequence: Synthetic oligonucleotide
  Target: SOD1; (+) strand; PAM type: NRG; PAM sequence: GAG
cttacagcatcattgtagaa

SEQ ID NO: 10540 - DNA, 20 bp, Artificial Sequence
  Description of Artificial Sequence: Synthetic oligonucleotide
  Target: SOD1; (+) strand; PAM type: NRG; PAM sequence: AGG
ttacagcatcattgtagaag

SEQ ID NO: 10541 - DNA, 20 bp, Artificial Sequence
  Description of Artificial Sequence: Synthetic oligonucleotide
  Target: SOD1; (+) strand; PAM type: NRG; PAM sequence: GGG
tacagcatcattgtagaaga

SEQ ID NO: 10542 - DNA, 20 bp, Artificial Sequence
  Description of Artificial Sequence: Synthetic oligonucleotide
  Target: SOD1; (+) strand; PAM type: NRG; PAM sequence: GAG
tttttgtttgtttgtttttt

SEQ ID NO: 10543 - DNA, 20 bp, Artificial Sequence
  Description of Artificial Sequence: Synthetic oligonucleotide
  Target: SOD1; (+) strand; PAM type: NRG; PAM sequence: CGG
tgtttgtttgttttttgaga

SEQ ID NO: 10544 - DNA, 20 bp, Artificial Sequence
  Description of Artificial Sequence: Synthetic oligonucleotide
  Target: SOD1; (+) strand; PAM type: NRG; PAM sequence: GAG
tttgtttgttttttgagacg

SEQ ID NO: 10545 - DNA, 20 bp, Artificial Sequence
  Description of Artificial Sequence: Synthetic oligonucleotide
  Target: SOD1; (+) strand; PAM type: NRG; PAM sequence: TGG
tgagacggagtcttactctg

SEQ ID NO: 10546 - DNA, 20 bp, Artificial Sequence
  Description of Artificial Sequence: Synthetic oligonucleotide
  Target: SOD1; (+) strand; PAM type: NRG; PAM sequence: CAG
cggagtcttactctgtggcc

SEQ ID NO: 10547 - DNA, 20 bp, Artificial Sequence
  Description of Artificial Sequence: Synthetic oligonucleotide
  Target: SOD1; (+) strand; PAM type: NRG; PAM sequence: AGG
ggagtcttactctgtggccc

SEQ ID NO: 10548 - DNA, 20 bp, Artificial Sequence
  Description of Artificial Sequence: Synthetic oligonucleotide
  Target: SOD1; (+) strand; PAM type: NRG; PAM sequence: TGG
tcttactctgtggcccaggc

SEQ ID NO: 10549 - DNA, 20 bp, Artificial Sequence
  Description of Artificial Sequence: Synthetic oligonucleotide
  Target: SOD1; (+) strand; PAM type: NRG; PAM sequence: GAG
ttactctgtggcccaggctg

SEQ ID NO: 10550 - DNA, 20 bp, Artificial Sequence
  Description of Artificial Sequence: Synthetic oligonucleotide
  Target: SOD1; (+) strand; PAM type: NRG; PAM sequence: CAG
ctgtggcccaggctggagtg

SEQ ID NO: 10551 - DNA, 20 bp, Artificial Sequence
  Description of Artificial Sequence: Synthetic oligonucleotide
  Target: SOD1; (+) strand; PAM type: NRG; PAM sequence: TGG
tggcccaggctggagtgcag

SEQ ID NO: 10552 - DNA, 20 bp, Artificial Sequence
  Description of Artificial Sequence: Synthetic oligonucleotide
  Target: SOD1; (+) strand; PAM type: NRG; PAM sequence: CGG
ggagtgcagtggcgcgatct

SEQ ID NO: 10553 - DNA, 20 bp, Artificial Sequence
  Description of Artificial Sequence: Synthetic oligonucleotide
  Target: SOD1; (+) strand; PAM type: NRG; PAM sequence: AAG
gcgcgatctcggctcactgc

SEQ ID NO: 10554 - DNA, 20 bp, Artificial Sequence
  Description of Artificial Sequence: Synthetic oligonucleotide
  Target: SOD1; (+) strand; PAM type: NRG; PAM sequence: CGG
tcactgcaagctccgcctcc

SEQ ID NO: 10555 - DNA, 20 bp, Artificial Sequence
  Description of Artificial Sequence: Synthetic oligonucleotide
  Target: SOD1; (+) strand; PAM type: NRG; PAM sequence: GGG
cactgcaagctccgcctccc

SEQ ID NO: 10556 - DNA, 20 bp, Artificial Sequence
  Description of Artificial Sequence: Synthetic oligonucleotide
  Target: SOD1; (+) strand; PAM type: NRG; PAM sequence: CAG
ttcatgccattctcctgcct

SEQ ID NO: 10557 - DNA, 20 bp, Artificial Sequence
  Description of Artificial Sequence: Synthetic oligonucleotide
  Target: SOD1; (+) strand; PAM type: NRG; PAM sequence: GAG
ttctcctgcctcagccccct

SEQ ID NO: 10558 - DNA, 20 bp, Artificial Sequence
  Description of Artificial Sequence: Synthetic oligonucleotide
  Target: SOD1; (+) strand; PAM type: NRG; PAM sequence: TAG
tcctgcctcagccccctgag

SEQ ID NO: 10559 - DNA, 20 bp, Artificial Sequence
  Description of Artificial Sequence: Synthetic oligonucleotide
  Target: SOD1; (+) strand; PAM type: NRG; PAM sequence: TGG
gcctcagccccctgagtagc

SEQ ID NO: 10560 - DNA, 20 bp, Artificial Sequence
  Description of Artificial Sequence: Synthetic oligonucleotide
  Target: SOD1; (+) strand; PAM type: NRG; PAM sequence: GGG
cctcagccccctgagtagct

SEQ ID NO: 10561 - DNA, 20 bp, Artificial Sequence
  Description of Artificial Sequence: Synthetic oligonucleotide
  Target: SOD1; (+) strand; PAM type: NRG; PAM sequence: CAG
cccctgagtagctgggacta

SEQ ID NO: 10562 - DNA, 20 bp, Artificial Sequence
  Description of Artificial Sequence: Synthetic oligonucleotide
  Target: SOD1; (+) strand; PAM type: NRG; PAM sequence: AGG
ccctgagtagctgggactac

SEQ ID NO: 10563 - DNA, 20 bp, Artificial Sequence
  Description of Artificial Sequence: Synthetic oligonucleotide
  Target: SOD1; (+) strand; PAM type: NRG; PAM sequence: TGG
caggtgcccgccaccccgcc

SEQ ID NO: 10564 - DNA, 20 bp, Artificial Sequence
  Description of Artificial Sequence: Synthetic oligonucleotide
  Target: SOD1; (+) strand; PAM type: NRG; PAM sequence: TAG
tggctaattttttgtatttt

SEQ ID NO: 10565 - DNA, 20 bp, Artificial Sequence
  Description of Artificial Sequence: Synthetic oligonucleotide
  Target: SOD1; (+) strand; PAM type: NRG; PAM sequence: TAG
ctaattttttgtatttttag

SEQ ID NO: 10566 - DNA, 20 bp, Artificial Sequence
  Description of Artificial Sequence: Synthetic oligonucleotide
  Target: SOD1; (+) strand; PAM type: NRG; PAM sequence: GAG
aattttttgtatttttagta

SEQ ID NO: 10567 - DNA, 20 bp, Artificial Sequence
  Description of Artificial Sequence: Synthetic oligonucleotide
  Target: SOD1; (+) strand; PAM type: NRG; PAM sequence: CGG
ttttgtatttttagtagaga

SEQ ID NO: 10568 - DNA, 20 bp, Artificial Sequence
  Description of Artificial Sequence: Synthetic oligonucleotide
  Target: SOD1; (+) strand; PAM type: NRG; PAM sequence: GGG
tttgtatttttagtagagac

SEQ ID NO: 10569 - DNA, 20 bp, Artificial Sequence
  Description of Artificial Sequence: Synthetic oligonucleotide
  Target: SOD1; (+) strand; PAM type: NRG; PAM sequence: GGG
ttgtatttttagtagagacg

SEQ ID NO: 10570 - DNA, 20 bp, Artificial Sequence
  Description of Artificial Sequence: Synthetic oligonucleotide
  Target: SOD1; (+) strand; PAM type: NRG; PAM sequence: TAG
gagacggggtttcactgtgt

SEQ ID NO: 10571 - DNA, 20 bp, Artificial Sequence
  Description of Artificial Sequence: Synthetic oligonucleotide
  Target: SOD1; (+) strand; PAM type: NRG; PAM sequence: AAG
ggggtttcactgtgttagcc

SEQ ID NO: 10572 - DNA, 20 bp, Artificial Sequence
  Description of Artificial Sequence: Synthetic oligonucleotide
  Target: SOD1; (+) strand; PAM type: NRG; PAM sequence: TGG
tttcactgtgttagccaaga

SEQ ID NO: 10573 - DNA, 20 bp, Artificial Sequence
  Description of Artificial Sequence: Synthetic oligonucleotide
  Target: SOD1; (+) strand; PAM type: NRG; PAM sequence: CAG
acctcgtgatccgcctgtct

SEQ ID NO: 10574 - DNA, 20 bp, Artificial Sequence
  Description of Artificial Sequence: Synthetic oligonucleotide
  Target: SOD1; (+) strand; PAM type: NRG; PAM sequence: AAG
ccgcctgtctcagcctccca

SEQ ID NO: 10575 - DNA, 20 bp, Artificial Sequence
  Description of Artificial Sequence: Synthetic oligonucleotide
  Target: SOD1; (+) strand; PAM type: NRG; PAM sequence: TGG
gtctcagcctcccaaagtgc

SEQ ID NO: 10576 - DNA, 20 bp, Artificial Sequence
  Description of Artificial Sequence: Synthetic oligonucleotide
  Target: SOD1; (+) strand; PAM type: NRG; PAM sequence: GGG
tctcagcctcccaaagtgct

SEQ ID NO: 10577 - DNA, 20 bp, Artificial Sequence
  Description of Artificial Sequence: Synthetic oligonucleotide
  Target: SOD1; (+) strand; PAM type: NRG; PAM sequence: CAG
ctcccaaagtgctgggatta

SEQ ID NO: 10578 - DNA, 20 bp, Artificial Sequence
  Description of Artificial Sequence: Synthetic oligonucleotide
  Target: SOD1; (+) strand; PAM type: NRG; PAM sequence: AGG
tcccaaagtgctgggattac

SEQ ID NO: 10579 - DNA, 20 bp, Artificial Sequence
  Description of Artificial Sequence: Synthetic oligonucleotide
  Target: SOD1; (+) strand; PAM type: NRG; PAM sequence: GAG
agtgctgggattacaggcat

SEQ ID NO: 10580 - DNA, 20 bp, Artificial Sequence
  Description of Artificial Sequence: Synthetic oligonucleotide
  Target: SOD1; (+) strand; PAM type: NRG; PAM sequence: CAG
caggcatgagccaccgcacc

SEQ ID NO: 10581 - DNA, 20 bp, Artificial Sequence
  Description of Artificial Sequence: Synthetic oligonucleotide
  Target: SOD1; (+) strand; PAM type: NRG; PAM sequence: CAG
catgagccaccgcacccagc

SEQ ID NO: 10582 - DNA, 20 bp, Artificial Sequence
  Description of Artificial Sequence: Synthetic oligonucleotide
  Target: SOD1; (+) strand; PAM type: NRG; PAM sequence: AAG
gagccaccgcacccagccag

SEQ ID NO: 10583 - DNA, 20 bp, Artificial Sequence
  Description of Artificial Sequence: Synthetic oligonucleotide
  Target: SOD1; (+) strand; PAM type: NRG; PAM sequence: GAG
gccaccgcacccagccagaa

SEQ ID NO: 10584 - DNA, 20 bp, Artificial Sequence
  Description of Artificial Sequence: Synthetic oligonucleotide
  Target: SOD1; (+) strand; PAM type: NRG; PAM sequence: AGG
ccaccgcacccagccagaag

SEQ ID NO: 10585 - DNA, 20 bp, Artificial Sequence
  Description of Artificial Sequence: Synthetic oligonucleotide
  Target: SOD1; (+) strand; PAM type: NRG; PAM sequence: GGG
caccgcacccagccagaaga

SEQ ID NO: 10586 - DNA, 20 bp, Artificial Sequence
  Description of Artificial Sequence: Synthetic oligonucleotide
  Target: SOD1; (+) strand; PAM type: NRG; PAM sequence: AAG
ccagaagagggtgtttttta

SEQ ID NO: 10587 - DNA, 20 bp, Artificial Sequence
  Description of Artificial Sequence: Synthetic oligonucleotide
  Target: SOD1; (+) strand; PAM type: NRG; PAM sequence: AAG
gaagagggtgttttttaaag

SEQ ID NO: 10588 - DNA, 20 bp, Artificial Sequence
  Description of Artificial Sequence: Synthetic oligonucleotide
  Target: SOD1; (+) strand; PAM type: NRG; PAM sequence: AGG
aagagggtgttttttaaaga

SEQ ID NO: 10589 - DNA, 20 bp, Artificial Sequence
  Description of Artificial Sequence: Synthetic oligonucleotide
  Target: SOD1; (+) strand; PAM type: NRG; PAM sequence: TAG
tgttttttaaagaaggcaaa

SEQ ID NO: 10590 - DNA, 20 bp, Artificial Sequence
  Description of Artificial Sequence: Synthetic oligonucleotide
  Target: SOD1; (+) strand; PAM type: NRG; PAM sequence: AGG
gttttttaaagaaggcaaat

SEQ ID NO: 10591 - DNA, 20 bp, Artificial Sequence
  Description of Artificial Sequence: Synthetic oligonucleotide
  Target: SOD1; (+) strand; PAM type: NRG; PAM sequence: TGG
gcaaataggaaataaaaact

SEQ ID NO: 10592 - DNA, 20 bp, Artificial Sequence
  Description of Artificial Sequence: Synthetic oligonucleotide
  Target: SOD1; (+) strand; PAM type: NRG; PAM sequence: GGG
caaataggaaataaaaactt

SEQ ID NO: 10593 - DNA, 20 bp, Artificial Sequence
  Description of Artificial Sequence: Synthetic oligonucleotide
  Target: SOD1; (+) strand; PAM type: NRG; PAM sequence: CAG
cttaacttttgtaatgatcc

SEQ ID NO: 10594 - DNA, 20 bp, Artificial Sequence
  Description of Artificial Sequence: Synthetic oligonucleotide
  Target: SOD1; (+) strand; PAM type: NRG; PAM sequence: AGG
ttaacttttgtaatgatccc

SEQ ID NO: 10595 - DNA, 20 bp, Artificial Sequence
  Description of Artificial Sequence: Synthetic oligonucleotide
  Target: SOD1; (+) strand; PAM type: NRG; PAM sequence: GAG
tgtaatgatcccaggtgttt

SEQ ID NO: 10596 - DNA, 20 bp, Artificial Sequence
  Description of Artificial Sequence: Synthetic oligonucleotide
  Target: SOD1; (+) strand; PAM type: NRG; PAM sequence: TGG
atgatcccaggtgtttgagc

SEQ ID NO: 10597 - DNA, 20 bp, Artificial Sequence
  Description of Artificial Sequence: Synthetic oligonucleotide
  Target: SOD1; (+) strand; PAM type: NRG; PAM sequence: GGG
tgatcccaggtgtttgagct

SEQ ID NO: 10598 - DNA, 20 bp, Artificial Sequence
  Description of Artificial Sequence: Synthetic oligonucleotide
  Target: SOD1; (+) strand; PAM type: NRG; PAM sequence: GGG
gatcccaggtgtttgagctg

SEQ ID NO: 10599 - DNA, 20 bp, Artificial Sequence
  Description of Artificial Sequence: Synthetic oligonucleotide
  Target: SOD1; (+) strand; PAM type: NRG; PAM sequence: GGG
atcccaggtgtttgagctgg

SEQ ID NO: 10600 - DNA, 20 bp, Artificial Sequence
  Description of Artificial Sequence: Synthetic oligonucleotide
  Target: SOD1; (+) strand; PAM type: NRG; PAM sequence: GAG
aggtgtttgagctgggggtt

SEQ ID NO: 10601 - DNA, 20 bp, Artificial Sequence
  Description of Artificial Sequence: Synthetic oligonucleotide
  Target: SOD1; (+) strand; PAM type: NRG; PAM sequence: AGG
ggtgtttgagctgggggttg

SEQ ID NO: 10602 - DNA, 20 bp, Artificial Sequence
  Description of Artificial Sequence: Synthetic oligonucleotide
  Target: SOD1; (+) strand; PAM type: NRG; PAM sequence: GGG
gtgtttgagctgggggttga

SEQ ID NO: 10603 - DNA, 20 bp, Artificial Sequence
  Description of Artificial Sequence: Synthetic oligonucleotide
  Target: SOD1; (+) strand; PAM type: NRG; PAM sequence: TGG
tttgagctgggggttgaggg

SEQ ID NO: 10604 - DNA, 20 bp, Artificial Sequence
  Description of Artificial Sequence: Synthetic oligonucleotide
  Target: SOD1; (+) strand; PAM type: NRG; PAM sequence: GGG
ttgagctgggggttgagggt

SEQ ID NO: 10605 - DNA, 20 bp, Artificial Sequence
  Description of Artificial Sequence: Synthetic oligonucleotide
  Target: SOD1; (+) strand; PAM type: NRG; PAM sequence: GAG
gggttgagggtgggtgcctc

SEQ ID NO: 10606 - DNA, 20 bp, Artificial Sequence
  Description of Artificial Sequence: Synthetic oligonucleotide
  Target: SOD1; (+) strand; PAM type: NRG; PAM sequence: AAG
gagggtgggtgcctcgagca

SEQ ID NO: 10607 - DNA, 20 bp, Artificial Sequence
  Description of Artificial Sequence: Synthetic oligonucleotide
  Target: SOD1; (+) strand; PAM type: NRG; PAM sequence: AGG
agggtgggtgcctcgagcaa

SEQ ID NO: 10608 - DNA, 20 bp, Artificial Sequence
  Description of Artificial Sequence: Synthetic oligonucleotide
  Target: SOD1; (+) strand; PAM type: NRG; PAM sequence: GGG
gggtgggtgcctcgagcaaa

SEQ ID NO: 10609 - DNA, 20 bp, Artificial Sequence
  Description of Artificial Sequence: Synthetic oligonucleotide
  Target: SOD1; (+) strand; PAM type: NRG; PAM sequence: GGG
ggtgggtgcctcgagcaaag

SEQ ID NO: 10610 - DNA, 20 bp, Artificial Sequence
  Description of Artificial Sequence: Synthetic oligonucleotide
  Target: SOD1; (+) strand; PAM type: NRG; PAM sequence: AAG
ttatttgcataatgccatgt

SEQ ID NO: 10611 - DNA, 20 bp, Artificial Sequence
  Description of Artificial Sequence: Synthetic oligonucleotide
  Target: SOD1; (+) strand; PAM type: NRG; PAM sequence: GAG
atttgcataatgccatgtaa

SEQ ID NO: 10612 - DNA, 20 bp, Artificial Sequence
  Description of Artificial Sequence: Synthetic oligonucleotide
  Target: SOD1; (+) strand; PAM type: NRG; PAM sequence: TAG
tgcataatgccatgtaagag

SEQ ID NO: 10613 - DNA, 20 bp, Artificial Sequence
  Description of Artificial Sequence: Synthetic oligonucleotide
  Target: SOD1; (+) strand; PAM type: NRG; PAM sequence: CAG
gtagctctacaccccaaaca

SEQ ID NO: 10614 - DNA, 20 bp, Artificial Sequence
  Description of Artificial Sequence: Synthetic oligonucleotide
  Target: SOD1; (+) strand; PAM type: NRG; PAM sequence: AGG
tagctctacaccccaaacac

SEQ ID NO: 10615 - DNA, 20 bp, Artificial Sequence
  Description of Artificial Sequence: Synthetic oligonucleotide
  Target: SOD1; (+) strand; PAM type: NRG; PAM sequence: TAG
caccccaaacacaggcttct

SEQ ID NO: 10616 - DNA, 20 bp, Artificial Sequence
  Description of Artificial Sequence: Synthetic oligonucleotide
  Target: SOD1; (+) strand; PAM type: NRG; PAM sequence: TGG
cccaaacacaggcttcttag

SEQ ID NO: 10617 - DNA, 20 bp, Artificial Sequence
  Description of Artificial Sequence: Synthetic oligonucleotide
  Target: SOD1; (+) strand; PAM type: NRG; PAM sequence: GGG
ccaaacacaggcttcttagt

SEQ ID NO: 10618 - DNA, 20 bp, Artificial Sequence
  Description of Artificial Sequence: Synthetic oligonucleotide
  Target: SOD1; (+) strand; PAM type: NRG; PAM sequence: AAG
caggcttcttagtgggacca

SEQ ID NO: 10619 - DNA, 20 bp, Artificial Sequence
  Description of Artificial Sequence: Synthetic oligonucleotide
  Target: SOD1; (+) strand; PAM type: NRG; PAM sequence: AAG
ccaaagtatgatacaaactg

SEQ ID NO: 10620 - DNA, 20 bp, Artificial Sequence
  Description of Artificial Sequence: Synthetic oligonucleotide
  Target: SOD1; (+) strand; PAM type: NRG; PAM sequence: TGG
agtatgatacaaactgaaga

SEQ ID NO: 10621 - DNA, 20 bp, Artificial Sequence
  Description of Artificial Sequence: Synthetic oligonucleotide
  Target: SOD1; (+) strand; PAM type: NRG; PAM sequence: CAG
tacaaactgaagatggaatg

SEQ ID NO: 10622 - DNA, 20 bp, Artificial Sequence
  Description of Artificial Sequence: Synthetic oligonucleotide
  Target: SOD1; (+) strand; PAM type: NRG; PAM sequence: GAG
caaactgaagatggaatgca

SEQ ID NO: 10623 - DNA, 20 bp, Artificial Sequence
  Description of Artificial Sequence: Synthetic oligonucleotide
  Target: SOD1; (+) strand; PAM type: NRG; PAM sequence: AGG
aaactgaagatggaatgcag

SEQ ID NO: 10624 - DNA, 20 bp, Artificial Sequence
  Description of Artificial Sequence: Synthetic oligonucleotide
  Target: SOD1; (+) strand; PAM type: NRG; PAM sequence: TGG
gatggaatgcagaggattat

SEQ ID NO: 10625 - DNA, 20 bp, Artificial Sequence
  Description of Artificial Sequence: Synthetic oligonucleotide
  Target: SOD1; (+) strand; PAM type: NRG; PAM sequence: TGG
gcagaggattattggtactt

SEQ ID NO: 10626 - DNA, 20 bp, Artificial Sequence
  Description of Artificial Sequence: Synthetic oligonucleotide
  Target: SOD1; (+) strand; PAM type: NRG; PAM sequence: AAG
gcttaaaaaaaattttttta

SEQ ID NO: 10627 - DNA, 20 bp, Artificial Sequence
  Description of Artificial Sequence: Synthetic oligonucleotide
  Target: SOD1; (+) strand; PAM type: NRG; PAM sequence: CAG
ttaaagtatttttaaaaaat

SEQ ID NO: 10628 - DNA, 20 bp, Artificial Sequence
  Description of Artificial Sequence: Synthetic oligonucleotide
  Target: SOD1; (+) strand; PAM type: NRG; PAM sequence: AGG
taaagtatttttaaaaaatc

SEQ ID NO: 10629 - DNA, 20 bp, Artificial Sequence
  Description of Artificial Sequence: Synthetic oligonucleotide
  Target: SOD1; (+) strand; PAM type: NRG; PAM sequence: CAG
aaatcaggcaacccctgaac

SEQ ID NO: 10630 - DNA, 20 bp, Artificial Sequence
  Description of Artificial Sequence: Synthetic oligonucleotide
  Target: SOD1; (+) strand; PAM type: NRG; PAM sequence: GAG
atcaggcaacccctgaacca

SEQ ID NO: 10631 - DNA, 20 bp, Artificial Sequence
  Description of Artificial Sequence: Synthetic oligonucleotide
  Target: SOD1; (+) strand; PAM type: NRG; PAM sequence: TAG
aggcaacccctgaaccagag

SEQ ID NO: 10632 - DNA, 20 bp, Artificial Sequence
  Description of Artificial Sequence: Synthetic oligonucleotide
  Target: SOD1; (+) strand; PAM type: NRG; PAM sequence: AGG
ggcaacccctgaaccagagt

SEQ ID NO: 10633 - DNA, 20 bp, Artificial Sequence
  Description of Artificial Sequence: Synthetic oligonucleotide
  Target: SOD1; (+) strand; PAM type: NRG; PAM sequence: CAG
cccctgaaccagagtaggtt

SEQ ID NO: 10634 - DNA, 20 bp, Artificial Sequence
  Description of Artificial Sequence: Synthetic oligonucleotide
  Target: SOD1; (+) strand; PAM type: NRG; PAM sequence: GAG
cctgaaccagagtaggttca

SEQ ID NO: 10635 - DNA, 20 bp, Artificial Sequence
  Description of Artificial Sequence: Synthetic oligonucleotide
  Target: SOD1; (+) strand; PAM type: NRG; PAM sequence: TGG
caaattttattttcttaatt

SEQ ID NO: 10636 - DNA, 20 bp, Artificial Sequence
  Description of Artificial Sequence: Synthetic oligonucleotide
  Target: SOD1; (+) strand; PAM type: NRG; PAM sequence: GGG
aaattttattttcttaattt

SEQ ID NO: 10637 - DNA, 20 bp, Artificial Sequence
  Description of Artificial Sequence: Synthetic oligonucleotide
  Target: SOD1; (+) strand; PAM type: NRG; PAM sequence: TGG
ttattttcttaatttgggat

SEQ ID NO: 10638 - DNA, 20 bp, Artificial Sequence
  Description of Artificial Sequence: Synthetic oligonucleotide
  Target: SOD1; (+) strand; PAM type: NRG; PAM sequence: AAG
ttttcttaatttgggattgg

SEQ ID NO: 10639 - DNA, 20 bp, Artificial Sequence
  Description of Artificial Sequence: Synthetic oligonucleotide
  Target: SOD1; (+) strand; PAM type: NRG; PAM sequence: AAG
cttaatttgggattggaagc

SEQ ID NO: 10640 - DNA, 20 bp, Artificial Sequence
  Description of Artificial Sequence: Synthetic oligonucleotide
  Target: SOD1; (+) strand; PAM type: NRG; PAM sequence: CAG
tgggattggaagcaagttaa

SEQ ID NO: 10641 - DNA, 20 bp, Artificial Sequence
  Description of Artificial Sequence: Synthetic oligonucleotide
  Target: SOD1; (+) strand; PAM type: NRG; PAM sequence: AAG
gattggaagcaagttaacag

SEQ ID NO: 10642 - DNA, 20 bp, Artificial Sequence
  Description of Artificial Sequence: Synthetic oligonucleotide
  Target: SOD1; (+) strand; PAM type: NRG; PAM sequence: GAG
gcaagttaacagaagtttat

SEQ ID NO: 10643 - DNA, 20 bp, Artificial Sequence
  Description of Artificial Sequence: Synthetic oligonucleotide
  Target: SOD1; (+) strand; PAM type: NRG; PAM sequence: AAG
ttaacagaagtttatgagtt

SEQ ID NO: 10644 - DNA, 20 bp, Artificial Sequence
  Description of Artificial Sequence: Synthetic oligonucleotide
  Target: SOD1; (+) strand; PAM type: NRG; PAM sequence: TAG
tttatgagttaagttgcatt

SEQ ID NO: 10645 - DNA, 20 bp, Artificial Sequence
  Description of Artificial Sequence: Synthetic oligonucleotide
  Target: SOD1; (+) strand; PAM type: NRG; PAM sequence: GAG
agtgatcttttgccatattt

SEQ ID NO: 10646 - DNA, 20 bp, Artificial Sequence
  Description of Artificial Sequence: Synthetic oligonucleotide
  Target: SOD1; (+) strand; PAM type: NRG; PAM sequence: TAG
taatctgatttttttgttta

SEQ ID NO: 10647 - DNA, 20 bp, Artificial Sequence
  Description of Artificial Sequence: Synthetic oligonucleotide
  Target: SOD1; (+) strand; PAM type: NRG; PAM sequence: TAG
ctttattcatcttgctaatt

SEQ ID NO: 10648 - DNA, 20 bp, Artificial Sequence
  Description of Artificial Sequence: Synthetic oligonucleotide
  Target: SOD1; (+) strand; PAM type: NRG; PAM sequence: TAG
cttgctaatttagtttcaaa

SEQ ID NO: 10649 - DNA, 20 bp, Artificial Sequence
  Description of Artificial Sequence: Synthetic oligonucleotide
  Target: SOD1; (+) strand; PAM type: NRG; PAM sequence: CAG
aaatagtgatttgtaatgat

SEQ ID NO: 10650 - DNA, 20 bp, Artificial Sequence
  Description of Artificial Sequence: Synthetic oligonucleotide
  Target: SOD1; (+) strand; PAM type: NRG; PAM sequence: GAG
gtaattgctgaaattccccc

SEQ ID NO: 10651 - DNA, 20 bp, Artificial Sequence
  Description of Artificial Sequence: Synthetic oligonucleotide
  Target: SOD1; (+) strand; PAM type: NRG; PAM sequence: TGG
aattcccccgagttgctttt

SEQ ID NO: 10652 - DNA, 20 bp, Artificial Sequence
  Description of Artificial Sequence: Synthetic oligonucleotide
  Target: SOD1; (+) strand; PAM type: NRG; PAM sequence: TGG
ctttttggctttaccgcctc

SEQ ID NO: 10653 - DNA, 20 bp, Artificial Sequence
  Description of Artificial Sequence: Synthetic oligonucleotide
  Target: SOD1; (+) strand; PAM type: NRG; PAM sequence: TGG
tggctttaccgcctctggtc

SEQ ID NO: 10654 - DNA, 20 bp, Artificial Sequence
  Description of Artificial Sequence: Synthetic oligonucleotide
  Target: SOD1; (+) strand; PAM type: NRG; PAM sequence: GGG
ggctttaccgcctctggtct

SEQ ID NO: 10655 - DNA, 20 bp, Artificial Sequence
  Description of Artificial Sequence: Synthetic oligonucleotide
  Target: SOD1; (+) strand; PAM type: NRG; PAM sequence: GAG
ctttaccgcctctggtctgg

SEQ ID NO: 10656 - DNA, 20 bp, Artificial Sequence
  Description of Artificial Sequence: Synthetic oligonucleotide
  Target: SOD1; (+) strand; PAM type: NRG; PAM sequence: AGG
tttaccgcctctggtctggg

SEQ ID NO: 10657 - DNA, 20 bp, Artificial Sequence
  Description of Artificial Sequence: Synthetic oligonucleotide
  Target: SOD1; (+) strand; PAM type: NRG; PAM sequence: TGG
tgcctgcctttctccctgtg

SEQ ID NO: 10658 - DNA, 20 bp, Artificial Sequence
  Description of Artificial Sequence: Synthetic oligonucleotide
  Target: SOD1; (+) strand; PAM type: NRG; PAM sequence: GGG
gcctgcctttctccctgtgt

SEQ ID NO: 10659 - DNA, 20 bp, Artificial Sequence
  Description of Artificial Sequence: Synthetic oligonucleotide
  Target: SOD1; (+) strand; PAM type: NRG; PAM sequence: CGG
ctccctgtgtgggactcctg

SEQ ID NO: 10660 - DNA, 20 bp, Artificial Sequence
  Description of Artificial Sequence: Synthetic oligonucleotide
  Target: SOD1; (+) strand; PAM type: NRG; PAM sequence: GGG
tccctgtgtgggactcctgc

SEQ ID NO: 10661 - DNA, 20 bp, Artificial Sequence
  Description of Artificial Sequence: Synthetic oligonucleotide
  Target: SOD1; (+) strand; PAM type: NRG; PAM sequence: GAG
tgtgtgggactcctgcgggt

SEQ ID NO: 10662 - DNA, 20 bp, Artificial Sequence
  Description of Artificial Sequence: Synthetic oligonucleotide
  Target: SOD1; (+) strand; PAM type: NRG; PAM sequence: GAG
tgtgggactcctgcgggtga

SEQ ID NO: 10663 - DNA, 20 bp, Artificial Sequence
  Description of Artificial Sequence: Synthetic oligonucleotide
  Target: SOD1; (+) strand; PAM type: NRG; PAM sequence: TGG
gactcctgcgggtgagagcg

SEQ ID NO: 10664 - DNA, 20 bp, Artificial Sequence
  Description of Artificial Sequence: Synthetic oligonucleotide
  Target: SOD1; (+) strand; PAM type: NRG; PAM sequence: AAG
tgcgggtgagagcgtggctg

SEQ ID NO: 10665 - DNA, 20 bp, Artificial Sequence
  Description of Artificial Sequence: Synthetic oligonucleotide
  Target: SOD1; (+) strand; PAM type: NRG; PAM sequence: CAG
ggtgagagcgtggctgaaga

SEQ ID NO: 10666 - DNA, 20 bp, Artificial Sequence
  Description of Artificial Sequence: Synthetic oligonucleotide
  Target: SOD1; (+) strand; PAM type: NRG; PAM sequence: AAG
tgaagacagccgtgttatga

SEQ ID NO: 10667 - DNA, 20 bp, Artificial Sequence
  Description of Artificial Sequence: Synthetic oligonucleotide
  Target: SOD1; (+) strand; PAM type: NRG; PAM sequence: AGG
gaagacagccgtgttatgaa

SEQ ID NO: 10668 - DNA, 20 bp, Artificial Sequence
  Description of Artificial Sequence: Synthetic oligonucleotide
  Target: SOD1; (+) strand; PAM type: NRG; PAM sequence: GGG
aagacagccgtgttatgaaa

SEQ ID NO: 10669 - DNA, 20 bp, Artificial Sequence
  Description of Artificial Sequence: Synthetic oligonucleotide
  Target: SOD1; (+) strand; PAM type: NRG; PAM sequence: GAG
aaagggcctcctgtgctgtc

SEQ ID NO: 10670 - DNA, 20 bp, Artificial Sequence
  Description of Artificial Sequence: Synthetic oligonucleotide
  Target: SOD1; (+) strand; PAM type: NRG; PAM sequence: AGG
aagggcctcctgtgctgtcg

SEQ ID NO: 10671 - DNA, 20 bp, Artificial Sequence
  Description of Artificial Sequence: Synthetic oligonucleotide
  Target: SOD1; (+) strand; PAM type: NRG; PAM sequence: TGG
gctctgtgaatgtcatcccc

SEQ ID NO: 10672 - DNA, 20 bp, Artificial Sequence
  Description of Artificial Sequence: Synthetic oligonucleotide
  Target: SOD1; (+) strand; PAM type: NRG; PAM sequence: CAG
gaatgtcatcccctggtgca

SEQ ID NO: 10673 - DNA, 20 bp, Artificial Sequence
  Description of Artificial Sequence: Synthetic oligonucleotide
  Target: SOD1; (+) strand; PAM type: NRG; PAM sequence: CAG
tgtcatcccctggtgcacag

SEQ ID NO: 10674 - DNA, 20 bp, Artificial Sequence
  Description of Artificial Sequence: Synthetic oligonucleotide
  Target: SOD1; (+) strand; PAM type: NRG; PAM sequence: CAG
gcacagcagcaccttctaca

SEQ ID NO: 10675 - DNA, 20 bp, Artificial Sequence
  Description of Artificial Sequence: Synthetic oligonucleotide
  Target: SOD1; (+) strand; PAM type: NRG; PAM sequence: AGG
cacagcagcaccttctacac

SEQ ID NO: 10676 - DNA, 20 bp, Artificial Sequence
  Description of Artificial Sequence: Synthetic oligonucleotide
  Target: SOD1; (+) strand; PAM type: NRG; PAM sequence: CAG
agcaccttctacacaggata

SEQ ID NO: 10677 - DNA, 20 bp, Artificial Sequence
  Description of Artificial Sequence: Synthetic oligonucleotide
  Target: SOD1; (+) strand; PAM type: NRG; PAM sequence: TGG
ccttctacacaggatacagt

SEQ ID NO: 10678 - DNA, 20 bp, Artificial Sequence
  Description of Artificial Sequence: Synthetic oligonucleotide
  Target: SOD1; (+) strand; PAM type: NRG; PAM sequence: GAG
agttggaatgccgccccctc

SEQ ID NO: 10679 - DNA, 20 bp, Artificial Sequence
  Description of Artificial Sequence: Synthetic oligonucleotide
  Target: SOD1; (+) strand; PAM type: NRG; PAM sequence: AAG
gccgccccctcgagttgtgt

SEQ ID NO: 10680 - DNA, 20 bp, Artificial Sequence
  Description of Artificial Sequence: Synthetic oligonucleotide
  Target: SOD1; (+) strand; PAM type: NRG; PAM sequence: AGG
ccgccccctcgagttgtgta

SEQ ID NO: 10681 - DNA, 20 bp, Artificial Sequence
  Description of Artificial Sequence: Synthetic oligonucleotide
  Target: SOD1; (+) strand; PAM type: NRG; PAM sequence: CAG
ccccctcgagttgtgtaagg

SEQ ID NO: 10682 - DNA, 20 bp, Artificial Sequence
  Description of Artificial Sequence: Synthetic oligonucleotide
  Target: SOD1; (+) strand; PAM type: NRG; PAM sequence: CAG
cctcgagttgtgtaaggcag

SEQ ID NO: 10683 - DNA, 20 bp, Artificial Sequence
  Description of Artificial Sequence: Synthetic oligonucleotide
  Target: SOD1; (+) strand; PAM type: NRG; PAM sequence: TGG
gttgtgtaaggcagcagcct

SEQ ID NO: 10684 - DNA, 20 bp, Artificial Sequence
  Description of Artificial Sequence: Synthetic oligonucleotide
  Target: SOD1; (+) strand; PAM type: NRG; PAM sequence: AAG
cagccttggcccttgcacat

SEQ ID NO: 10685 - DNA, 20 bp, Artificial Sequence
  Description of Artificial Sequence: Synthetic oligonucleotide
  Target: SOD1; (+) strand; PAM type: NRG; PAM sequence: AAG
ttgaatattctgcctgcacc

SEQ ID NO: 10686 - DNA, 20 bp, Artificial Sequence
  Description of Artificial Sequence: Synthetic oligonucleotide
  Target: SOD1; (+) strand; PAM type: NRG; PAM sequence: AAG
tattctgcctgcaccaagta

SEQ ID NO: 10687 - DNA, 20 bp, Artificial Sequence
  Description of Artificial Sequence: Synthetic oligonucleotide
  Target: SOD1; (+) strand; PAM type: NRG; PAM sequence: AGG
attctgcctgcaccaagtaa

SEQ ID NO: 10688 - DNA, 20 bp, Artificial Sequence
  Description of Artificial Sequence: Synthetic oligonucleotide
  Target: SOD1; (+) strand; PAM type: NRG; PAM sequence: GGG
ttctgcctgcaccaagtaaa

SEQ ID NO: 10689 - DNA, 20 bp, Artificial Sequence
  Description of Artificial Sequence: Synthetic oligonucleotide
  Target: SOD1; (+) strand; PAM type: NRG; PAM sequence: CAG
cctgcaccaagtaaagggca

SEQ ID NO: 10690 - DNA, 20 bp, Artificial Sequence
  Description of Artificial Sequence: Synthetic oligonucleotide
  Target: SOD1; (+) strand; PAM type: NRG; PAM sequence: TAG
caccaagtaaagggcacaga

SEQ ID NO: 10691 - DNA, 20 bp, Artificial Sequence
  Description of Artificial Sequence: Synthetic oligonucleotide
  Target: SOD1; (+) strand; PAM type: NRG; PAM sequence: TGG
agggcacagatagaactgct

SEQ ID NO: 10692 - DNA, 20 bp, Artificial Sequence
  Description of Artificial Sequence: Synthetic oligonucleotide
  Target: SOD1; (+) strand; PAM type: NRG; PAM sequence: TGG
aactgcttggcatatgttgc

SEQ ID NO: 10693 - DNA, 20 bp, Artificial Sequence
  Description of Artificial Sequence: Synthetic oligonucleotide
  Target: SOD1; (+) strand; PAM type: NRG; PAM sequence: GGG
actgcttggcatatgttgct

SEQ ID NO: 10694 - DNA, 20 bp, Artificial Sequence
  Description of Artificial Sequence: Synthetic oligonucleotide
  Target: SOD1; (+) strand; PAM type: NRG; PAM sequence: GGG
ctgcttggcatatgttgctg

SEQ ID NO: 10695 - DNA, 20 bp, Artificial Sequence
  Description of Artificial Sequence: Synthetic oligonucleotide
  Target: SOD1; (+) strand; PAM type: NRG; PAM sequence: GAG
gcttggcatatgttgctggg

SEQ ID NO: 10696 - DNA, 20 bp, Artificial Sequence
  Description of Artificial Sequence: Synthetic oligonucleotide
  Target: SOD1; (+) strand; PAM type: NRG; PAM sequence: GAG
gcatatgttgctggggagat

SEQ ID NO: 10697 - DNA, 20 bp, Artificial Sequence
  Description of Artificial Sequence: Synthetic oligonucleotide
  Target: SOD1; (+) strand; PAM type: NRG; PAM sequence: AAG
ggggagatgagttttttgta

SEQ ID NO: 10698 - DNA, 20 bp, Artificial Sequence
  Description of Artificial Sequence: Synthetic oligonucleotide
  Target: SOD1; (+) strand; PAM type: NRG; PAM sequence: AAG
gtaaagtatactacgttctt

SEQ ID NO: 10699 - DNA, 20 bp, Artificial Sequence
  Description of Artificial Sequence: Synthetic oligonucleotide
  Target: SOD1; (+) strand; PAM type: NRG; PAM sequence: TGG
atactacgttcttaagaatt

SEQ ID NO: 10700 - DNA, 20 bp, Artificial Sequence
  Description of Artificial Sequence: Synthetic oligonucleotide
  Target: SOD1; (+) strand; PAM type: NRG; PAM sequence: TGG
aagaatttggatcataacca

SEQ ID NO: 10701 - DNA, 20 bp, Artificial Sequence
  Description of Artificial Sequence: Synthetic oligonucleotide
  Target: SOD1; (+) strand; PAM type: NRG; PAM sequence: GGG
agaatttggatcataaccat

SEQ ID NO: 10702 - DNA, 20 bp, Artificial Sequence
  Description of Artificial Sequence: Synthetic oligonucleotide
  Target: SOD1; (+) strand; PAM type: NRG; PAM sequence: TAG
taaccatgggattttaataa

SEQ ID NO: 10703 - DNA, 20 bp, Artificial Sequence
  Description of Artificial Sequence: Synthetic oligonucleotide
  Target: SOD1; (+) strand; PAM type: NRG; PAM sequence: AAG
taataatagaaaaactgttg

SEQ ID NO: 10704 - DNA, 20 bp, Artificial Sequence
  Description of Artificial Sequence: Synthetic oligonucleotide
  Target: SOD1; (+) strand; PAM type: NRG; PAM sequence: CAG
atagaaaaactgttgaagat

SEQ ID NO: 10705 - DNA, 20 bp, Artificial Sequence
  Description of Artificial Sequence: Synthetic oligonucleotide
  Target: SOD1; (+) strand; PAM type: NRG; PAM sequence: TGG
aaaactgttgaagatcagtc

SEQ ID NO: 10706 - DNA, 20 bp, Artificial Sequence
  Description of Artificial Sequence: Synthetic oligonucleotide
  Target: SOD1; (+) strand; PAM type: NRG; PAM sequence: CAG
agtctggtcccttattttta

SEQ ID NO: 10707 - DNA, 20 bp, Artificial Sequence
  Description of Artificial Sequence: Synthetic oligonucleotide
  Target: SOD1; (+) strand; PAM type: NRG; PAM sequence: AAG
ggtcccttatttttacagtg

SEQ ID NO: 10708 - DNA, 20 bp, Artificial Sequence
  Description of Artificial Sequence: Synthetic oligonucleotide
  Target: SOD1; (+) strand; PAM type: NRG; PAM sequence: AAG
cccttatttttacagtgaag

SEQ ID NO: 10709 - DNA, 20 bp, Artificial Sequence
  Description of Artificial Sequence: Synthetic oligonucleotide
  Target: SOD1; (+) strand; PAM type: NRG; PAM sequence: AAG
tttttacagtgaagaagcca

SEQ ID NO: 10710 - DNA, 20 bp, Artificial Sequence
  Description of Artificial Sequence: Synthetic oligonucleotide
  Target: SOD1; (+) strand; PAM type: NRG; PAM sequence: CAG
acagtgaagaagccaaagcc

SEQ ID NO: 10711 - DNA, 20 bp, Artificial Sequence
  Description of Artificial Sequence: Synthetic oligonucleotide
  Target: SOD1; (+) strand; PAM type: NRG; PAM sequence: GAG
agtgaagaagccaaagccca

SEQ ID NO: 10712 - DNA, 20 bp, Artificial Sequence
  Description of Artificial Sequence: Synthetic oligonucleotide
  Target: SOD1; (+) strand; PAM type: NRG; PAM sequence: AAG
gaagaagccaaagcccagag

SEQ ID NO: 10713 - DNA, 20 bp, Artificial Sequence
  Description of Artificial Sequence: Synthetic oligonucleotide
  Target: SOD1; (+) strand; PAM type: NRG; PAM sequence: AGG
aagaagccaaagcccagaga

SEQ ID NO: 10714 - DNA, 20 bp, Artificial Sequence
  Description of Artificial Sequence: Synthetic oligonucleotide
  Target: SOD1; (+) strand; PAM type: NRG; PAM sequence: GGG
agaagccaaagcccagagaa

SEQ ID NO: 10715 - DNA, 20 bp, Artificial Sequence
  Description of Artificial Sequence: Synthetic oligonucleotide
  Target: SOD1; (+) strand; PAM type: NRG; PAM sequence: AAG
gagaagggtgttaactttac

SEQ ID NO: 10716 - DNA, 20 bp, Artificial Sequence
  Description of Artificial Sequence: Synthetic oligonucleotide
  Target: SOD1; (+) strand; PAM type: NRG; PAM sequence: CAG
ggtgttaactttacaagtgt

SEQ ID NO: 10717 - DNA, 20 bp, Artificial Sequence
  Description of Artificial Sequence: Synthetic oligonucleotide
  Target: SOD1; (+) strand; PAM type: NRG; PAM sequence: CAG
ttaactttacaagtgtcaga

SEQ ID NO: 10718 - DNA, 20 bp, Artificial Sequence
  Description of Artificial Sequence: Synthetic oligonucleotide
  Target: SOD1; (+) strand; PAM type: NRG; PAM sequence: TAG
actttacaagtgtcagacag

SEQ ID NO: 10719 - DNA, 20 bp, Artificial Sequence
  Description of Artificial Sequence: Synthetic oligonucleotide
  Target: SOD1; (+) strand; PAM type: NRG; PAM sequence: TAG
tacaagtgtcagacagtagt

SEQ ID NO: 10720 - DNA, 20 bp, Artificial Sequence
  Description of Artificial Sequence: Synthetic oligonucleotide
  Target: SOD1; (+) strand; PAM type: NRG; PAM sequence: TGG
gtcagacagtagttagaact

SEQ ID NO: 10721 - DNA, 20 bp, Artificial Sequence
  Description of Artificial Sequence: Synthetic oligonucleotide
  Target: SOD1; (+) strand; PAM type: NRG; PAM sequence: TGG
agacagtagttagaacttgg

SEQ ID NO: 10722 - DNA, 20 bp, Artificial Sequence
  Description of Artificial Sequence: Synthetic oligonucleotide
  Target: SOD1; (+) strand; PAM type: NRG; PAM sequence: GGG
gacagtagttagaacttggt

SEQ ID NO: 10723 - DNA, 20 bp, Artificial Sequence
  Description of Artificial Sequence: Synthetic oligonucleotide
  Target: SOD1; (+) strand; PAM type: NRG; PAM sequence: GGG
acagtagttagaacttggtg

SEQ ID NO: 10724 - DNA, 20 bp, Artificial Sequence
  Description of Artificial Sequence: Synthetic oligonucleotide
  Target: SOD1; (+) strand; PAM type: NRG; PAM sequence: GAG
gttttttttttttttttttt

SEQ ID NO: 10725 - DNA, 20 bp, Artificial Sequence
  Description of Artificial Sequence: Synthetic oligonucleotide
  Target: SOD1; (+) strand; PAM type: NRG; PAM sequence: TGG
ttttttttttttttttgaga

SEQ ID NO: 10726 - DNA, 20 bp, Artificial Sequence
  Description of Artificial Sequence: Synthetic oligonucleotide
  Target: SOD1; (+) strand; PAM type: NRG; PAM sequence: GAG
ttttttttttttttgagatg

SEQ ID NO: 10727 - DNA, 20 bp, Artificial Sequence
  Description of Artificial Sequence: Synthetic oligonucleotide
  Target: SOD1; (+) strand; PAM type: NRG; PAM sequence: CAG
tggagtcttgctctgttgcc

SEQ ID NO: 10728 - DNA, 20 bp, Artificial Sequence
  Description of Artificial Sequence: Synthetic oligonucleotide
  Target: SOD1; (+) strand; PAM type: NRG; PAM sequence: AGG
ggagtcttgctctgttgccc

SEQ ID NO: 10729 - DNA, 20 bp, Artificial Sequence
  Description of Artificial Sequence: Synthetic oligonucleotide
  Target: SOD1; (+) strand; PAM type: NRG; PAM sequence: TGG
tcttgctctgttgcccaggc

SEQ ID NO: 10730 - DNA, 20 bp, Artificial Sequence
  Description of Artificial Sequence: Synthetic oligonucleotide
  Target: SOD1; (+) strand; PAM type: NRG; PAM sequence: GAG
ttgctctgttgcccaggctg

SEQ ID NO: 10731 - DNA, 20 bp, Artificial Sequence
  Description of Artificial Sequence: Synthetic oligonucleotide
  Target: SOD1; (+) strand; PAM type: NRG; PAM sequence: CAG
ctgttgcccaggctggagtg

SEQ ID NO: 10732 - DNA, 20 bp, Artificial Sequence
  Description of Artificial Sequence: Synthetic oligonucleotide
  Target: SOD1; (+) strand; PAM type: NRG; PAM sequence: TGG
ttgcccaggctggagtgcag

SEQ ID NO: 10733 - DNA, 20 bp, Artificial Sequence
  Description of Artificial Sequence: Synthetic oligonucleotide
  Target: SOD1; (+) strand; PAM type: NRG; PAM sequence: CAG
ggagtgcagtggtgcgatct

SEQ ID NO: 10734 - DNA, 20 bp, Artificial Sequence
  Description of Artificial Sequence: Synthetic oligonucleotide
  Target: SOD1; (+) strand; PAM type: NRG; PAM sequence: CAG
tcactgcaacctctgcctcc

SEQ ID NO: 10735 - DNA, 20 bp, Artificial Sequence
  Description of Artificial Sequence: Synthetic oligonucleotide
  Target: SOD1; (+) strand; PAM type: NRG; PAM sequence: AGG
cactgcaacctctgcctccc

SEQ ID NO: 10736 - DNA, 20 bp, Artificial Sequence
  Description of Artificial Sequence: Synthetic oligonucleotide
  Target: SOD1; (+) strand; PAM type: NRG; PAM sequence: AAG
aacctctgcctcccaggttc

SEQ ID NO: 10737 - DNA, 20 bp, Artificial Sequence
  Description of Artificial Sequence: Synthetic oligonucleotide
  Target: SOD1; (+) strand; PAM type: NRG; PAM sequence: CAG
ttcaagcgattctcctgcct

SEQ ID NO: 10738 - DNA, 20 bp, Artificial Sequence
  Description of Artificial Sequence: Synthetic oligonucleotide
  Target: SOD1; (+) strand; PAM type: NRG; PAM sequence: AAG
ttctcctgcctcagcctact

SEQ ID NO: 10739 - DNA, 20 bp, Artificial Sequence
  Description of Artificial Sequence: Synthetic oligonucleotide
  Target: SOD1; (+) strand; PAM type: NRG; PAM sequence: TAG
tcctgcctcagcctactaag

SEQ ID NO: 10740 - DNA, 20 bp, Artificial Sequence
  Description of Artificial Sequence: Synthetic oligonucleotide
  Target: SOD1; (+) strand; PAM type: NRG; PAM sequence: TGG
gcctcagcctactaagtagc

SEQ ID NO: 10741 - DNA, 20 bp, Artificial Sequence
  Description of Artificial Sequence: Synthetic oligonucleotide
  Target: SOD1; (+) strand; PAM type: NRG; PAM sequence: GGG
cctcagcctactaagtagct

SEQ ID NO: 10742 - DNA, 20 bp, Artificial Sequence
  Description of Artificial Sequence: Synthetic oligonucleotide
  Target: SOD1; (+) strand; PAM type: NRG; PAM sequence: TAG
ctactaagtagctgggacta

SEQ ID NO: 10743 - DNA, 20 bp, Artificial Sequence
  Description of Artificial Sequence: Synthetic oligonucleotide
  Target: SOD1; (+) strand; PAM type: NRG; PAM sequence: AGG
tactaagtagctgggactat

SEQ ID NO: 10744 - DNA, 20 bp, Artificial Sequence
  Description of Artificial Sequence: Synthetic oligonucleotide
  Target: SOD1; (+) strand; PAM type: NRG; PAM sequence: TAG
taggtgcgcaccaccacgcc

SEQ ID NO: 10745 - DNA, 20 bp, Artificial Sequence
  Description of Artificial Sequence: Synthetic oligonucleotide
  Target: SOD1; (+) strand; PAM type: NRG; PAM sequence: CAG
agctaatttttgtatttttt

SEQ ID NO: 10746 - DNA, 20 bp, Artificial Sequence
  Description of Artificial Sequence: Synthetic oligonucleotide
  Target: SOD1; (+) strand; PAM type: NRG; PAM sequence: TAG
taatttttgtattttttcag

SEQ ID NO: 10747 - DNA, 20 bp, Artificial Sequence
  Description of Artificial Sequence: Synthetic oligonucleotide
  Target: SOD1; (+) strand; PAM type: NRG; PAM sequence: GAG
atttttgtattttttcagta

SEQ ID NO: 10748 - DNA, 20 bp, Artificial Sequence
  Description of Artificial Sequence: Synthetic oligonucleotide
  Target: SOD1; (+) strand; PAM type: NRG; PAM sequence: CAG
ttgtattttttcagtagaga

SEQ ID NO: 10749 - DNA, 20 bp, Artificial Sequence
  Description of Artificial Sequence: Synthetic oligonucleotide
  Target: SOD1; (+) strand; PAM type: NRG; PAM sequence: AGG
tgtattttttcagtagagac

SEQ ID NO: 10750 - DNA, 20 bp, Artificial Sequence
  Description of Artificial Sequence: Synthetic oligonucleotide
  Target: SOD1; (+) strand; PAM type: NRG; PAM sequence: GGG
gtattttttcagtagagaca

SEQ ID NO: 10751 - DNA, 20 bp, Artificial Sequence
  Description of Artificial Sequence: Synthetic oligonucleotide
  Target: SOD1; (+) strand; PAM type: NRG; PAM sequence: TGG
gagacagggttttgctatgc

SEQ ID NO: 10752 - DNA, 20 bp, Artificial Sequence
  Description of Artificial Sequence: Synthetic oligonucleotide
  Target: SOD1; (+) strand; PAM type: NRG; PAM sequence: CAG
cagggttttgctatgctggc

SEQ ID NO: 10753 - DNA, 20 bp, Artificial Sequence
  Description of Artificial Sequence: Synthetic oligonucleotide
  Target: SOD1; (+) strand; PAM type: NRG; PAM sequence: AGG
agggttttgctatgctggcc

SEQ ID NO: 10754 - DNA, 20 bp, Artificial Sequence
  Description of Artificial Sequence: Synthetic oligonucleotide
  Target: SOD1; (+) strand; PAM type: NRG; PAM sequence: TGG
ttttgctatgctggccaggc

SEQ ID NO: 10755 - DNA, 20 bp, Artificial Sequence
  Description of Artificial Sequence: Synthetic oligonucleotide
  Target: SOD1; (+) strand; PAM type: NRG; PAM sequence: CAG
tggtctcaaactcctgacct

SEQ ID NO: 10756 - DNA, 20 bp, Artificial Sequence
  Description of Artificial Sequence: Synthetic oligonucleotide
  Target: SOD1; (+) strand; PAM type: NRG; PAM sequence: CAG
actcctgacctcagatgatc

SEQ ID NO: 10757 - DNA, 20 bp, Artificial Sequence
  Description of Artificial Sequence: Synthetic oligonucleotide
  Target: SOD1; (+) strand; PAM type: NRG; PAM sequence: CAG
ctcagatgatccagccacct

SEQ ID NO: 10758 - DNA, 20 bp, Artificial Sequence
  Description of Artificial Sequence: Synthetic oligonucleotide
  Target: SOD1; (+) strand; PAM type: NRG; PAM sequence: AAG
ccagccacctcagcttccca

SEQ ID NO: 10759 - DNA, 20 bp, Artificial Sequence
  Description of Artificial Sequence: Synthetic oligonucleotide
  Target: SOD1; (+) strand; PAM type: NRG; PAM sequence: TGG
acctcagcttcccaaagtgc

SEQ ID NO: 10760 - DNA, 20 bp, Artificial Sequence
  Description of Artificial Sequence: Synthetic oligonucleotide
  Target: SOD1; (+) strand; PAM type: NRG; PAM sequence: GGG
cctcagcttcccaaagtgct

SEQ ID NO: 10761 - DNA, 20 bp, Artificial Sequence
  Description of Artificial Sequence: Synthetic oligonucleotide
  Target: SOD1; (+) strand; PAM type: NRG; PAM sequence: GGG
ctcagcttcccaaagtgctg

SEQ ID NO: 10762 - DNA, 20 bp, Artificial Sequence
  Description of Artificial Sequence: Synthetic oligonucleotide
  Target: SOD1; (+) strand; PAM type: NRG; PAM sequence: CAG
ttcccaaagtgctggggttc

SEQ ID NO: 10763 - DNA, 20 bp, Artificial Sequence
  Description of Artificial Sequence: Synthetic oligonucleotide
  Target: SOD1; (+) strand; PAM type: NRG; PAM sequence: AGG
tcccaaagtgctggggttcc

SEQ ID NO: 10764 - DNA, 20 bp, Artificial Sequence
  Description of Artificial Sequence: Synthetic oligonucleotide
  Target: SOD1; (+) strand; PAM type: NRG; PAM sequence: TAG
agtgctggggttccaggtgt

SEQ ID NO: 10765 - DNA, 20 bp, Artificial Sequence
  Description of Artificial Sequence: Synthetic oligonucleotide
  Target: SOD1; (+) strand; PAM type: NRG; PAM sequence: TGG
caggtgttagccaccatgcc

SEQ ID NO: 10766 - DNA, 20 bp, Artificial Sequence
  Description of Artificial Sequence: Synthetic oligonucleotide
  Target: SOD1; (+) strand; PAM type: NRG; PAM sequence: TAG
ttagccaccatgcctggcca

SEQ ID NO: 10767 - DNA, 20 bp, Artificial Sequence
  Description of Artificial Sequence: Synthetic oligonucleotide
  Target: SOD1; (+) strand; PAM type: NRG; PAM sequence: TGG
tttctgttcccttctcactg

SEQ ID NO: 10768 - DNA, 20 bp, Artificial Sequence
  Description of Artificial Sequence: Synthetic oligonucleotide
  Target: SOD1; (+) strand; PAM type: NRG; PAM sequence: AAG
cttctcactgtggctgtacc

SEQ ID NO: 10769 - DNA, 20 bp, Artificial Sequence
  Description of Artificial Sequence: Synthetic oligonucleotide
  Target: SOD1; (+) strand; PAM type: NRG; PAM sequence: AGG
ttctcactgtggctgtacca

SEQ ID NO: 10770 - DNA, 20 bp, Artificial Sequence
  Description of Artificial Sequence: Synthetic oligonucleotide
  Target: SOD1; (+) strand; PAM type: NRG; PAM sequence: CAG
taccaaggtgttgcttatcc

SEQ ID NO: 10771 - DNA, 20 bp, Artificial Sequence
  Description of Artificial Sequence: Synthetic oligonucleotide
  Target: SOD1; (+) strand; PAM type: NRG; PAM sequence: AAG
caaggtgttgcttatcccag

SEQ ID NO: 10772 - DNA, 20 bp, Artificial Sequence
  Description of Artificial Sequence: Synthetic oligonucleotide
  Target: SOD1; (+) strand; PAM type: NRG; PAM sequence: CAG
ttatcccagaagtcgtgatg

SEQ ID NO: 10773 - DNA, 20 bp, Artificial Sequence
  Description of Artificial Sequence: Synthetic oligonucleotide
  Target: SOD1; (+) strand; PAM type: NRG; PAM sequence: AGG
tatcccagaagtcgtgatgc

SEQ ID NO: 10774 - DNA, 20 bp, Artificial Sequence
  Description of Artificial Sequence: Synthetic oligonucleotide
  Target: SOD1; (+) strand; PAM type: NRG; PAM sequence: CAG
ccagaagtcgtgatgcaggt

SEQ ID NO: 10775 - DNA, 20 bp, Artificial Sequence
  Description of Artificial Sequence: Synthetic oligonucleotide
  Target: SOD1; (+) strand; PAM type: NRG; PAM sequence: TGG
gcaggtcagcactttctcca

SEQ ID NO: 10776 - DNA, 20 bp, Artificial Sequence
  Description of Artificial Sequence: Synthetic oligonucleotide
  Target: SOD1; (+) strand; PAM type: NRG; PAM sequence: GGG
caggtcagcactttctccat

SEQ ID NO: 10777 - DNA, 20 bp, Artificial Sequence
  Description of Artificial Sequence: Synthetic oligonucleotide
  Target: SOD1; (+) strand; PAM type: NRG; PAM sequence: AAG
gtcagcactttctccatggg

SEQ ID NO: 10778 - DNA, 20 bp, Artificial Sequence
  Description of Artificial Sequence: Synthetic oligonucleotide
  Target: SOD1; (+) strand; PAM type: NRG; PAM sequence: TAG
actttctccatgggaagttt

SEQ ID NO: 10779 - DNA, 20 bp, Artificial Sequence
  Description of Artificial Sequence: Synthetic oligonucleotide
  Target: SOD1; (+) strand; PAM type: NRG; PAM sequence: CAG
ttctccatgggaagttttag

SEQ ID NO: 10780 - DNA, 20 bp, Artificial Sequence
  Description of Artificial Sequence: Synthetic oligonucleotide
  Target: SOD1; (+) strand; PAM type: NRG; PAM sequence: TAG
gttttagcagtgtttctttt

SEQ ID NO: 10781 - DNA, 20 bp, Artificial Sequence
  Description of Artificial Sequence: Synthetic oligonucleotide
  Target: SOD1; (+) strand; PAM type: NRG; PAM sequence: TGG
gtttctttttagaatgtatt

SEQ ID NO: 10782 - DNA, 20 bp, Artificial Sequence
  Description of Artificial Sequence: Synthetic oligonucleotide
  Target: SOD1; (+) strand; PAM type: NRG; PAM sequence: GGG
tttctttttagaatgtattt

SEQ ID NO: 10783 - DNA, 20 bp, Artificial Sequence
  Description of Artificial Sequence: Synthetic oligonucleotide
  Target: SOD1; (+) strand; PAM type: NRG; PAM sequence: TAG
gggaactttaattcataatt

SEQ ID NO: 10784 - DNA, 20 bp, Artificial Sequence
  Description of Artificial Sequence: Synthetic oligonucleotide
  Target: SOD1; (+) strand; PAM type: NRG; PAM sequence: TAG
ttttttcttcttcttataaa

SEQ ID NO: 10785 - DNA, 20 bp, Artificial Sequence
  Description of Artificial Sequence: Synthetic oligonucleotide
  Target: SOD1; (+) strand; PAM type: NRG; PAM sequence: AGG
tttttcttcttcttataaat

SEQ ID NO: 10786 - DNA, 20 bp, Artificial Sequence
  Description of Artificial Sequence: Synthetic oligonucleotide
  Target: SOD1; (+) strand; PAM type: NRG; PAM sequence: CAG
ttcttataaataggctgtac

SEQ ID NO: 10787 - DNA, 20 bp, Artificial Sequence
  Description of Artificial Sequence: Synthetic oligonucleotide
  Target: SOD1; (+) strand; PAM type: NRG; PAM sequence: CAG
ataaataggctgtaccagtg

SEQ ID NO: 10788 - DNA, 20 bp, Artificial Sequence
  Description of Artificial Sequence: Synthetic oligonucleotide
  Target: SOD1; (+) strand; PAM type: NRG; PAM sequence: AGG
taaataggctgtaccagtgc

SEQ ID NO: 10789 - DNA, 20 bp, Artificial Sequence
  Description of Artificial Sequence: Synthetic oligonucleotide
  Target: SOD1; (+) strand; PAM type: NRG; PAM sequence: CAG
cctcactttaatcctctatc

SEQ ID NO: 10790 - DNA, 20 bp, Artificial Sequence
  Description of Artificial Sequence: Synthetic oligonucleotide
  Target: SOD1; (+) strand; PAM type: NRG; PAM sequence: CGG
aatcctctatccagaaaaca

SEQ ID NO: 10791 - DNA, 20 bp, Artificial Sequence
  Description of Artificial Sequence: Synthetic oligonucleotide
  Target: SOD1; (+) strand; PAM type: NRG; PAM sequence: TGG
cctctatccagaaaacacgg

SEQ ID NO: 10792 - DNA, 20 bp, Artificial Sequence
  Description of Artificial Sequence: Synthetic oligonucleotide
  Target: SOD1; (+) strand; PAM type: NRG; PAM sequence: GGG
ctctatccagaaaacacggt

SEQ ID NO: 10793 - DNA, 20 bp, Artificial Sequence
  Description of Artificial Sequence: Synthetic oligonucleotide
  Target: SOD1; (+) strand; PAM type: NRG; PAM sequence: AAG
ccagaaaacacggtgggcca

SEQ ID NO: 10794 - DNA, 20 bp, Artificial Sequence
  Description of Artificial Sequence: Synthetic oligonucleotide
  Target: SOD1; (+) strand; PAM type: NRG; PAM sequence: AGG
cagaaaacacggtgggccaa

SEQ ID NO: 10795 - DNA, 20 bp, Artificial Sequence
  Description of Artificial Sequence: Synthetic oligonucleotide
  Target: SOD1; (+) strand; PAM type: NRG; PAM sequence: AAG
acacggtgggccaaaggatg

SEQ ID NO: 10796 - DNA, 20 bp, Artificial Sequence
  Description of Artificial Sequence: Synthetic oligonucleotide
  Target: SOD1; (+) strand; PAM type: NRG; PAM sequence: GAG
acggtgggccaaaggatgaa

SEQ ID NO: 10797 - DNA, 20 bp, Artificial Sequence
  Description of Artificial Sequence: Synthetic oligonucleotide
  Target: SOD1; (+) strand; PAM type: NRG; PAM sequence: GAG
ggtgggccaaaggatgaaga

SEQ ID NO: 10798 - DNA, 20 bp, Artificial Sequence
  Description of Artificial Sequence: Synthetic oligonucleotide
  Target: SOD1; (+) strand; PAM type: NRG; PAM sequence: AGG
gtgggccaaaggatgaagag

SEQ ID NO: 10799 - DNA, 20 bp, Artificial Sequence
  Description of Artificial Sequence: Synthetic oligonucleotide
  Target: SOD1; (+) strand; PAM type: NRG; PAM sequence: AAG
aaaggatgaagagaggtaac

SEQ ID NO: 10800 - DNA, 20 bp, Artificial Sequence
  Description of Artificial Sequence: Synthetic oligonucleotide
  Target: SOD1; (+) strand; PAM type: NRG; PAM sequence: TGG
atgcttaactcttgtaataa

SEQ ID NO: 10801 - DNA, 20 bp, Artificial Sequence
  Description of Artificial Sequence: Synthetic oligonucleotide
  Target: SOD1; (+) strand; PAM type: NRG; PAM sequence: TAG
aactcttgtaataatggcga

SEQ ID NO: 10802 - DNA, 20 bp, Artificial Sequence
  Description of Artificial Sequence: Synthetic oligonucleotide
  Target: SOD1; (+) strand; PAM type: NRG; PAM sequence: TGG
taataatggcgatagctttc

SEQ ID NO: 10803 - DNA, 20 bp, Artificial Sequence
  Description of Artificial Sequence: Synthetic oligonucleotide
  Target: SOD1; (+) strand; PAM type: NRG; PAM sequence: GAG
ataatggcgatagctttctg

SEQ ID NO: 10804 - DNA, 20 bp, Artificial Sequence
  Description of Artificial Sequence: Synthetic oligonucleotide
  Target: SOD1; (+) strand; PAM type: NRG; PAM sequence: TGG
atagctttctggagttcata

SEQ ID NO: 10805 - DNA, 20 bp, Artificial Sequence
  Description of Artificial Sequence: Synthetic oligonucleotide
  Target: SOD1; (+) strand; PAM type: NRG; PAM sequence: AAG
actacttgtaaatatgtgct

SEQ ID NO: 10806 - DNA, 20 bp, Artificial Sequence
  Description of Artificial Sequence: Synthetic oligonucleotide
  Target: SOD1; (+) strand; PAM type: NRG; PAM sequence: TGG
aaacccctgctcccaaatgc

SEQ ID NO: 10807 - DNA, 20 bp, Artificial Sequence
  Description of Artificial Sequence: Synthetic oligonucleotide
  Target: SOD1; (+) strand; PAM type: NRG; PAM sequence: TGG
gctggaatgcttttacttcc

SEQ ID NO: 10808 - DNA, 20 bp, Artificial Sequence
  Description of Artificial Sequence: Synthetic oligonucleotide
  Target: SOD1; (+) strand; PAM type: NRG; PAM sequence: GGG
ctggaatgcttttacttcct

SEQ ID NO: 10809 - DNA, 20 bp, Artificial Sequence
  Description of Artificial Sequence: Synthetic oligonucleotide
  Target: SOD1; (+) strand; PAM type: NRG; PAM sequence: AAG
gcttttacttcctgggctta

SEQ ID NO: 10810 - DNA, 20 bp, Artificial Sequence
  Description of Artificial Sequence: Synthetic oligonucleotide
  Target: SOD1; (+) strand; PAM type: NRG; PAM sequence: AGG
cttttacttcctgggcttaa

SEQ ID NO: 10811 - DNA, 20 bp, Artificial Sequence
  Description of Artificial Sequence: Synthetic oligonucleotide
  Target: SOD1; (+) strand; PAM type: NRG; PAM sequence: TGG
ggcttaaaggaattgacaaa

SEQ ID NO: 10812 - DNA, 20 bp, Artificial Sequence
  Description of Artificial Sequence: Synthetic oligonucleotide
  Target: SOD1; (+) strand; PAM type: NRG; PAM sequence: GGG
gcttaaaggaattgacaaat

SEQ ID NO: 10813 - DNA, 20 bp, Artificial Sequence
  Description of Artificial Sequence: Synthetic oligonucleotide
  Target: SOD1; (+) strand; PAM type: NRG; PAM sequence: GGG
cttaaaggaattgacaaatg

SEQ ID NO: 10814 - DNA, 20 bp, Artificial Sequence
  Description of Artificial Sequence: Synthetic oligonucleotide
  Target: SOD1; (+) strand; PAM type: NRG; PAM sequence: TGG
tggggacacttaaaacgatt

SEQ ID NO: 10815 - DNA, 20 bp, Artificial Sequence
  Description of Artificial Sequence: Synthetic oligonucleotide
  Target: SOD1; (+) strand; PAM type: NRG; PAM sequence: TAG
cttaaaacgatttggttttg

SEQ ID NO: 10816 - DNA, 20 bp, Artificial Sequence
  Description of Artificial Sequence: Synthetic oligonucleotide
  Target: SOD1; (+) strand; PAM type: NRG; PAM sequence: TAG
tttgtagcatttattgaata

SEQ ID NO: 10817 - DNA, 20 bp, Artificial Sequence
  Description of Artificial Sequence: Synthetic oligonucleotide
  Target: SOD1; (+) strand; PAM type: NRG; PAM sequence: AAG
attgaatatagaactaatac

SEQ ID NO: 10818 - DNA, 20 bp, Artificial Sequence
  Description of Artificial Sequence: Synthetic oligonucleotide
  Target: SOD1; (+) strand; PAM type: NRG; PAM sequence: AAG
tagaactaatacaagtgcca

SEQ ID NO: 10819 - DNA, 20 bp, Artificial Sequence
  Description of Artificial Sequence: Synthetic oligonucleotide
  Target: SOD1; (+) strand; PAM type: NRG; PAM sequence: AGG
agaactaatacaagtgccaa

SEQ ID NO: 10820 - DNA, 20 bp, Artificial Sequence
  Description of Artificial Sequence: Synthetic oligonucleotide
  Target: SOD1; (+) strand; PAM type: NRG; PAM sequence: GGG
gaactaatacaagtgccaaa

SEQ ID NO: 10821 - DNA, 20 bp, Artificial Sequence
  Description of Artificial Sequence: Synthetic oligonucleotide
  Target: SOD1; (+) strand; PAM type: NRG; PAM sequence: GGG
aactaatacaagtgccaaag

SEQ ID NO: 10822 - DNA, 20 bp, Artificial Sequence
  Description of Artificial Sequence: Synthetic oligonucleotide
  Target: SOD1; (+) strand; PAM type: NRG; PAM sequence: CAG
gtgccaaaggggaactaata

SEQ ID NO: 10823 - DNA, 20 bp, Artificial Sequence
  Description of Artificial Sequence: Synthetic oligonucleotide
  Target: SOD1; (+) strand; PAM type: NRG; PAM sequence: AGG
tgccaaaggggaactaatac

SEQ ID NO: 10824 - DNA, 20 bp, Artificial Sequence
  Description of Artificial Sequence: Synthetic oligonucleotide
  Target: SOD1; (+) strand; PAM type: NRG; PAM sequence: CAG
aatacaggaaatgtcatgaa

SEQ ID NO: 10825 - DNA, 20 bp, Artificial Sequence
  Description of Artificial Sequence: Synthetic oligonucleotide
  Target: SOD1; (+) strand; PAM type: NRG; PAM sequence: TAG
tgaacagtactgtcaaccac

SEQ ID NO: 10826 - DNA, 20 bp, Artificial Sequence
  Description of Artificial Sequence: Synthetic oligonucleotide
  Target: SOD1; (+) strand; PAM type: NRG; PAM sequence: TAG
tcaatcatcattgtgaaaca

SEQ ID NO: 10827 - DNA, 20 bp, Artificial Sequence
  Description of Artificial Sequence: Synthetic oligonucleotide
  Target: SOD1; (+) strand; PAM type: NRG; PAM sequence: AGG
caatcatcattgtgaaacat

SEQ ID NO: 10828 - DNA, 20 bp, Artificial Sequence
  Description of Artificial Sequence: Synthetic oligonucleotide
  Target: SOD1; (+) strand; PAM type: NRG; PAM sequence: AAG
tcatcattgtgaaacatagg

SEQ ID NO: 10829 - DNA, 20 bp, Artificial Sequence
  Description of Artificial Sequence: Synthetic oligonucleotide
  Target: SOD1; (+) strand; PAM type: NRG; PAM sequence: TAG
tgaaacataggaagcttctg

SEQ ID NO: 10830 - DNA, 20 bp, Artificial Sequence
  Description of Artificial Sequence: Synthetic oligonucleotide
  Target: SOD1; (+) strand; PAM type: NRG; PAM sequence: TAG
aaaaaattgatactgaaaac

SEQ ID NO: 10831 - DNA, 20 bp, Artificial Sequence
  Description of Artificial Sequence: Synthetic oligonucleotide
  Target: SOD1; (+) strand; PAM type: NRG; PAM sequence: GAG
attgatactgaaaactagtc

SEQ ID NO: 10832 - DNA, 20 bp, Artificial Sequence
  Description of Artificial Sequence: Synthetic oligonucleotide
  Target: SOD1; (+) strand; PAM type: NRG; PAM sequence: AAG
tatatgtgtatgttttctga

SEQ ID NO: 10833 - DNA, 20 bp, Artificial Sequence
  Description of Artificial Sequence: Synthetic oligonucleotide
  Target: SOD1; (+) strand; PAM type: NRG; PAM sequence: CAG
tatgttttctgaaagccttt

SEQ ID NO: 10834 - DNA, 20 bp, Artificial Sequence
  Description of Artificial Sequence: Synthetic oligonucleotide
  Target: SOD1; (+) strand; PAM type: NRG; PAM sequence: AAG
ttcagaaaaatattaaattt

SEQ ID NO: 10835 - DNA, 20 bp, Artificial Sequence
  Description of Artificial Sequence: Synthetic oligonucleotide
  Target: SOD1; (+) strand; PAM type: NRG; PAM sequence: AGG
tcagaaaaatattaaattta

SEQ ID NO: 10836 - DNA, 20 bp, Artificial Sequence
  Description of Artificial Sequence: Synthetic oligonucleotide
  Target: SOD1; (+) strand; PAM type: NRG; PAM sequence: AAG
aaaatattaaatttaaggac

SEQ ID NO: 10837 - DNA, 20 bp, Artificial Sequence
  Description of Artificial Sequence: Synthetic oligonucleotide
  Target: SOD1; (+) strand; PAM type: NRG; PAM sequence: CAG
taaggacaagatttttatat

SEQ ID NO: 10838 - DNA, 20 bp, Artificial Sequence
  Description of Artificial Sequence: Synthetic oligonucleotide
  Target: SOD1; (+) strand; PAM type: NRG; PAM sequence: GAG
aggacaagatttttatatca

SEQ ID NO: 10839 - DNA, 20 bp, Artificial Sequence
  Description of Artificial Sequence: Synthetic oligonucleotide
  Target: SOD1; (+) strand; PAM type: NRG; PAM sequence: AGG
ggacaagatttttatatcag

SEQ ID NO: 10840 - DNA, 20 bp, Artificial Sequence
  Description of Artificial Sequence: Synthetic oligonucleotide
  Target: SOD1; (+) strand; PAM type: NRG; PAM sequence: TGG
gatttttatatcagaggcct

SEQ ID NO: 10841 - DNA, 20 bp, Artificial Sequence
  Description of Artificial Sequence: Synthetic oligonucleotide
  Target: SOD1; (+) strand; PAM type: NRG; PAM sequence: GGG
atttttatatcagaggcctt

SEQ ID NO: 10842 - DNA, 20 bp, Artificial Sequence
  Description of Artificial Sequence: Synthetic oligonucleotide
  Target: SOD1; (+) strand; PAM type: NRG; PAM sequence: TAG
atatcagaggccttgggaca

SEQ ID NO: 10843 - DNA, 20 bp, Artificial Sequence
  Description of Artificial Sequence: Synthetic oligonucleotide
  Target: SOD1; (+) strand; PAM type: NRG; PAM sequence: TAG
gccttgggacatagctttgt

SEQ ID NO: 10844 - DNA, 20 bp, Artificial Sequence
  Description of Artificial Sequence: Synthetic oligonucleotide
  Target: SOD1; (+) strand; PAM type: NRG; PAM sequence: CAG
catagctttgttagctatgc

SEQ ID NO: 10845 - DNA, 20 bp, Artificial Sequence
  Description of Artificial Sequence: Synthetic oligonucleotide
  Target: SOD1; (+) strand; PAM type: NRG; PAM sequence: CAG
ttagctatgccagtaattaa

SEQ ID NO: 10846 - DNA, 20 bp, Artificial Sequence
  Description of Artificial Sequence: Synthetic oligonucleotide
  Target: SOD1; (+) strand; PAM type: NRG; PAM sequence: AGG
tagctatgccagtaattaac

SEQ ID NO: 10847 - DNA, 20 bp, Artificial Sequence
  Description of Artificial Sequence: Synthetic oligonucleotide
  Target: SOD1; (+) strand; PAM type: NRG; PAM sequence: CAG
agtaattaacaggcataact

SEQ ID NO: 10848 - DNA, 20 bp, Artificial Sequence
  Description of Artificial Sequence: Synthetic oligonucleotide
  Target: SOD1; (+) strand; PAM type: NRG; PAM sequence: GAG
acaggcataactcagtaact

SEQ ID NO: 10849 - DNA, 20 bp, Artificial Sequence
  Description of Artificial Sequence: Synthetic oligonucleotide
  Target: SOD1; (+) strand; PAM type: NRG; PAM sequence: GAG
aggcataactcagtaactga

SEQ ID NO: 10850 - DNA, 20 bp, Artificial Sequence
  Description of Artificial Sequence: Synthetic oligonucleotide
  Target: SOD1; (+) strand; PAM type: NRG; PAM sequence: TGG
gtaactgagagtttaccctt

SEQ ID NO: 10851 - DNA, 20 bp, Artificial Sequence
  Description of Artificial Sequence: Synthetic oligonucleotide
  Target: SOD1; (+) strand; PAM type: NRG; PAM sequence: CAG
ccctttggtacttctgaaat

SEQ ID NO: 10852 - DNA, 20 bp, Artificial Sequence
  Description of Artificial Sequence: Synthetic oligonucleotide
  Target: SOD1; (+) strand; PAM type: NRG; PAM sequence: AGG
cctttggtacttctgaaatc

SEQ ID NO: 10853 - DNA, 20 bp, Artificial Sequence
  Description of Artificial Sequence: Synthetic oligonucleotide
  Target: SOD1; (+) strand; PAM type: NRG; PAM sequence: CAG
ggtacttctgaaatcaggtg

SEQ ID NO: 10854 - DNA, 20 bp, Artificial Sequence
  Description of Artificial Sequence: Synthetic oligonucleotide
  Target: SOD1; (+) strand; PAM type: NRG; PAM sequence: CAG
tgcagccccatctttcttcc

SEQ ID NO: 10855 - DNA, 20 bp, Artificial Sequence
  Description of Artificial Sequence: Synthetic oligonucleotide
  Target: SOD1; (+) strand; PAM type: NRG; PAM sequence: GAG
cagccccatctttcttccca

SEQ ID NO: 10856 - DNA, 20 bp, Artificial Sequence
  Description of Artificial Sequence: Synthetic oligonucleotide
  Target: SOD1; (+) strand; PAM type: NRG; PAM sequence: TAG
catctttcttcccagagcat

SEQ ID NO: 10857 - DNA, 20 bp, Artificial Sequence
  Description of Artificial Sequence: Synthetic oligonucleotide
  Target: SOD1; (+) strand; PAM type: NRG; PAM sequence: TAG
cttcccagagcattagtgtg

SEQ ID NO: 10858 - DNA, 20 bp, Artificial Sequence
  Description of Artificial Sequence: Synthetic oligonucleotide
  Target: SOD1; (+) strand; PAM type: NRG; PAM sequence: AAG
agcattagtgtgtagacgtg

SEQ ID NO: 10859 - DNA, 20 bp, Artificial Sequence
  Description of Artificial Sequence: Synthetic oligonucleotide
  Target: SOD1; (+) strand; PAM type: NRG; PAM sequence: AAG
tagacgtgaagccttgtttg

SEQ ID NO: 10860 - DNA, 20 bp, Artificial Sequence
  Description of Artificial Sequence: Synthetic oligonucleotide
  Target: SOD1; (+) strand; PAM type: NRG; PAM sequence: GAG
gacgtgaagccttgtttgaa

SEQ ID NO: 10861 - DNA, 20 bp, Artificial Sequence
  Description of Artificial Sequence: Synthetic oligonucleotide
  Target: SOD1; (+) strand; PAM type: NRG; PAM sequence: TAG
cttgtttgaagagctgtatt

SEQ ID NO: 10862 - DNA, 20 bp, Artificial Sequence
  Description of Artificial Sequence: Synthetic oligonucleotide
  Target: SOD1; (+) strand; PAM type: NRG; PAM sequence: TAG
agagctgtatttagaatgcc

SEQ ID NO: 10863 - DNA, 20 bp, Artificial Sequence
  Description of Artificial Sequence: Synthetic oligonucleotide
  Target: SOD1; (+) strand; PAM type: NRG; PAM sequence: CAG
tttgcaaatttgtgtctact

SEQ ID NO: 10864 - DNA, 20 bp, Artificial Sequence
  Description of Artificial Sequence: Synthetic oligonucleotide
  Target: SOD1; (+) strand; PAM type: NRG; PAM sequence: AAG
aaatttgtgtctactcagtc

SEQ ID NO: 10865 - DNA, 20 bp, Artificial Sequence
  Description of Artificial Sequence: Synthetic oligonucleotide
  Target: SOD1; (+) strand; PAM type: NRG; PAM sequence: TAG
tactcagtcaagttttaatt

SEQ ID NO: 10866 - DNA, 20 bp, Artificial Sequence
  Description of Artificial Sequence: Synthetic oligonucleotide
  Target: SOD1; (+) strand; PAM type: NRG; PAM sequence: TAG
tcatgaactaccttgatgtt

SEQ ID NO: 10867 - DNA, 20 bp, Artificial Sequence
  Description of Artificial Sequence: Synthetic oligonucleotide
  Target: SOD1; (+) strand; PAM type: NRG; PAM sequence: TGG
tgaactaccttgatgtttag

SEQ ID NO: 10868 - DNA, 20 bp, Artificial Sequence
  Description of Artificial Sequence: Synthetic oligonucleotide
  Target: SOD1; (+) strand; PAM type: NRG; PAM sequence: CAG
accttgatgtttagtggcat

SEQ ID NO: 10869 - DNA, 20 bp, Artificial Sequence
  Description of Artificial Sequence: Synthetic oligonucleotide
  Target: SOD1; (+) strand; PAM type: NRG; PAM sequence: TAG
atctgatgctttttcattat

SEQ ID NO: 10870 - DNA, 20 bp, Artificial Sequence
  Description of Artificial Sequence: Synthetic oligonucleotide
  Target: SOD1; (+) strand; PAM type: NRG; PAM sequence: AGG
tctgatgctttttcattatt

SEQ ID NO: 10871 - DNA, 20 bp, Artificial Sequence
  Description of Artificial Sequence: Synthetic oligonucleotide
  Target: SOD1; (+) strand; PAM type: NRG; PAM sequence: TGG
tttttcattattaggcatgt

SEQ ID NO: 10872 - DNA, 20 bp, Artificial Sequence
  Description of Artificial Sequence: Synthetic oligonucleotide
  Target: SOD1; (+) strand; PAM type: NRG; PAM sequence: GAG
tttcattattaggcatgttg

SEQ ID NO: 10873 - DNA, 20 bp, Artificial Sequence
  Description of Artificial Sequence: Synthetic oligonucleotide
  Target: SOD1; (+) strand; PAM type: NRG; PAM sequence: TGG
tattaggcatgttggagact

SEQ ID NO: 10874 - DNA, 20 bp, Artificial Sequence
  Description of Artificial Sequence: Synthetic oligonucleotide
  Target: SOD1; (+) strand; PAM type: NRG; PAM sequence: GGG
attaggcatgttggagactt

SEQ ID NO: 10875 - DNA, 20 bp, Artificial Sequence
  Description of Artificial Sequence: Synthetic oligonucleotide
  Target: SOD1; (+) strand; PAM type: NRG; PAM sequence: AAG
gggcaatgtgactgctgaca

SEQ ID NO: 10876 - DNA, 20 bp, Artificial Sequence
  Description of Artificial Sequence: Synthetic oligonucleotide
  Target: SOD1; (+) strand; PAM type: NRG; PAM sequence: TGG
aatgtgactgctgacaaaga

SEQ ID NO: 10877 - DNA, 20 bp, Artificial Sequence
  Description of Artificial Sequence: Synthetic oligonucleotide
  Target: SOD1; (+) strand; PAM type: NRG; PAM sequence: TGG
gactgctgacaaagatggtg

SEQ ID NO: 10878 - DNA, 20 bp, Artificial Sequence
  Description of Artificial Sequence: Synthetic oligonucleotide
  Target: SOD1; (+) strand; PAM type: NRG; PAM sequence: AAG
tgtggccgatgtgtctattg

SEQ ID NO: 10879 - DNA, 20 bp, Artificial Sequence
  Description of Artificial Sequence: Synthetic oligonucleotide
  Target: SOD1; (+) strand; PAM type: NRG; PAM sequence: CAG
agattctgtgatctcactct

SEQ ID NO: 10880 - DNA, 20 bp, Artificial Sequence
  Description of Artificial Sequence: Synthetic oligonucleotide
  Target: SOD1; (+) strand; PAM type: NRG; PAM sequence: AGG
gattctgtgatctcactctc

SEQ ID NO: 10881 - DNA, 20 bp, Artificial Sequence
  Description of Artificial Sequence: Synthetic oligonucleotide
  Target: SOD1; (+) strand; PAM type: NRG; PAM sequence: GAG
ttctgtgatctcactctcag

SEQ ID NO: 10882 - DNA, 20 bp, Artificial Sequence
  Description of Artificial Sequence: Synthetic oligonucleotide
  Target: SOD1; (+) strand; PAM type: NRG; PAM sequence: TGG
tcaggagaccattgcatcat

SEQ ID NO: 10883 - DNA, 20 bp, Artificial Sequence
  Description of Artificial Sequence: Synthetic oligonucleotide
  Target: SOD1; (+) strand; PAM type: NRG; PAM sequence: TGG
ttgcatcattggccgcacac

SEQ ID NO: 10884 - DNA, 20 bp, Artificial Sequence
  Description of Artificial Sequence: Synthetic oligonucleotide
  Target: SOD1; (+) strand; PAM type: NRG; PAM sequence: TGG
catcattggccgcacactgg

SEQ ID NO: 10885 - DNA, 20 bp, Artificial Sequence
  Description of Artificial Sequence: Synthetic oligonucleotide
  Target: SOD1; (+) strand; PAM type: NRG; PAM sequence: AAG
attggccgcacactggtggt

SEQ ID NO: 10886 - DNA, 20 bp, Artificial Sequence
  Description of Artificial Sequence: Synthetic oligonucleotide
  Target: SOD1; (+) strand; PAM type: NRG; PAM sequence: AAG
ctggtggtaagttttcataa

SEQ ID NO: 10887 - DNA, 20 bp, Artificial Sequence
  Description of Artificial Sequence: Synthetic oligonucleotide
  Target: SOD1; (+) strand; PAM type: NRG; PAM sequence: AGG
tggtggtaagttttcataaa

SEQ ID NO: 10888 - DNA, 20 bp, Artificial Sequence
  Description of Artificial Sequence: Synthetic oligonucleotide
  Target: SOD1; (+) strand; PAM type: NRG; PAM sequence: CAG
ataaaacttcttctaacata

SEQ ID NO: 10889 - DNA, 20 bp, Artificial Sequence
  Description of Artificial Sequence: Synthetic oligonucleotide
  Target: SOD1; (+) strand; PAM type: NRG; PAM sequence: TAG
tatcttttcactttgattgt

SEQ ID NO: 10890 - DNA, 20 bp, Artificial Sequence
  Description of Artificial Sequence: Synthetic oligonucleotide
  Target: SOD1; (+) strand; PAM type: NRG; PAM sequence: CGG
ttcactttgattgttagtcg

SEQ ID NO: 10891 - DNA, 20 bp, Artificial Sequence
  Description of Artificial Sequence: Synthetic oligonucleotide
  Target: SOD1; (+) strand; PAM type: NRG; PAM sequence: AAG
attgttagtcgcggtttcta

SEQ ID NO: 10892 - DNA, 20 bp, Artificial Sequence
  Description of Artificial Sequence: Synthetic oligonucleotide
  Target: SOD1; (+) strand; PAM type: NRG; PAM sequence: CAG
agtcgcggtttctaaagatc

SEQ ID NO: 10893 - DNA, 20 bp, Artificial Sequence
  Description of Artificial Sequence: Synthetic oligonucleotide
  Target: SOD1; (+) strand; PAM type: NRG; PAM sequence: CAG
atccagataaactgtacttg

SEQ ID NO: 10894 - DNA, 20 bp, Artificial Sequence
  Description of Artificial Sequence: Synthetic oligonucleotide
  Target: SOD1; (+) strand; PAM type: NRG; PAM sequence: TAG
actgtacttgcagttcaaat

SEQ ID NO: 10895 - DNA, 20 bp, Artificial Sequence
  Description of Artificial Sequence: Synthetic oligonucleotide
  Target: SOD1; (+) strand; PAM type: NRG; PAM sequence: AGG
ctgtacttgcagttcaaatt

SEQ ID NO: 10896 - DNA, 20 bp, Artificial Sequence
  Description of Artificial Sequence: Synthetic oligonucleotide
  Target: SOD1; (+) strand; PAM type: NRG; PAM sequence: AAG
cttgcagttcaaattaggaa

SEQ ID NO: 10897 - DNA, 20 bp, Artificial Sequence
  Description of Artificial Sequence: Synthetic oligonucleotide
  Target: SOD1; (+) strand; PAM type: NRG; PAM sequence: TGG
attaggaaaagcaattttat

SEQ ID NO: 10898 - DNA, 20 bp, Artificial Sequence
  Description of Artificial Sequence: Synthetic oligonucleotide
  Target: SOD1; (+) strand; PAM type: NRG; PAM sequence: CGG
gcaattttattggacaatta

SEQ ID NO: 10899 - DNA, 20 bp, Artificial Sequence
  Description of Artificial Sequence: Synthetic oligonucleotide
  Target: SOD1; (+) strand; PAM type: NRG; PAM sequence: TAG
tgaaaatgaattattttatc

SEQ ID NO: 10900 - DNA, 20 bp, Artificial Sequence
  Description of Artificial Sequence: Synthetic oligonucleotide
  Target: SOD1; (+) strand; PAM type: NRG; PAM sequence: AGG
gaaaatgaattattttatct

SEQ ID NO: 10901 - DNA, 20 bp, Artificial Sequence
  Description of Artificial Sequence: Synthetic oligonucleotide
  Target: SOD1; (+) strand; PAM type: NRG; PAM sequence: CAG
atgaattattttatctaggt

SEQ ID NO: 10902 - DNA, 20 bp, Artificial Sequence
  Description of Artificial Sequence: Synthetic oligonucleotide
  Target: SOD1; (+) strand; PAM type: NRG; PAM sequence: AAG
ttattttatctaggtcagtt

SEQ ID NO: 10903 - DNA, 20 bp, Artificial Sequence
  Description of Artificial Sequence: Synthetic oligonucleotide
  Target: SOD1; (+) strand; PAM type: NRG; PAM sequence: AAG
gttaagaacactgttctgct

SEQ ID NO: 10904 - DNA, 20 bp, Artificial Sequence
  Description of Artificial Sequence: Synthetic oligonucleotide
  Target: SOD1; (+) strand; PAM type: NRG; PAM sequence: CAG
aacactgttctgctaagatg

SEQ ID NO: 10905 - DNA, 20 bp, Artificial Sequence
  Description of Artificial Sequence: Synthetic oligonucleotide
  Target: SOD1; (+) strand; PAM type: NRG; PAM sequence: AAG
ttctgctaagatgcagtaaa

SEQ ID NO: 10906 - DNA, 20 bp, Artificial Sequence
  Description of Artificial Sequence: Synthetic oligonucleotide
  Target: SOD1; (+) strand; PAM type: NRG; PAM sequence: CAG
tgctaagatgcagtaaaaag

SEQ ID NO: 10907 - DNA, 20 bp, Artificial Sequence
  Description of Artificial Sequence: Synthetic oligonucleotide
  Target: SOD1; (+) strand; PAM type: NRG; PAM sequence: AGG
gctaagatgcagtaaaaagc

SEQ ID NO: 10908 - DNA, 20 bp, Artificial Sequence
  Description of Artificial Sequence: Synthetic oligonucleotide
  Target: SOD1; (+) strand; PAM type: NRG; PAM sequence: TAG
caggttacatttgaccatat

SEQ ID NO: 10909 - DNA, 20 bp, Artificial Sequence
  Description of Artificial Sequence: Synthetic oligonucleotide
  Target: SOD1; (+) strand; PAM type: NRG; PAM sequence: GAG
catttgaccatattagatct

SEQ ID NO: 10910 - DNA, 20 bp, Artificial Sequence
  Description of Artificial Sequence: Synthetic oligonucleotide
  Target: SOD1; (+) strand; PAM type: NRG; PAM sequence: TGG
gaccatattagatctgagtt

SEQ ID NO: 10911 - DNA, 20 bp, Artificial Sequence
  Description of Artificial Sequence: Synthetic oligonucleotide
  Target: SOD1; (+) strand; PAM type: NRG; PAM sequence: CAG
ttagatctgagtttggaaaa

SEQ ID NO: 10912 - DNA, 20 bp, Artificial Sequence
  Description of Artificial Sequence: Synthetic oligonucleotide
  Target: SOD1; (+) strand; PAM type: NRG; PAM sequence: AAG
gatctgagtttggaaaacag

SEQ ID NO: 10913 - DNA, 20 bp, Artificial Sequence
  Description of Artificial Sequence: Synthetic oligonucleotide
  Target: SOD1; (+) strand; PAM type: NRG; PAM sequence: TAG
ctgagtttggaaaacagaag

SEQ ID NO: 10914 - DNA, 20 bp, Artificial Sequence
  Description of Artificial Sequence: Synthetic oligonucleotide
  Target: SOD1; (+) strand; PAM type: NRG; PAM sequence: TAG
tggaaaacagaagtagtctt

SEQ ID NO: 10915 - DNA, 20 bp, Artificial Sequence
  Description of Artificial Sequence: Synthetic oligonucleotide
  Target: SOD1; (+) strand; PAM type: NRG; PAM sequence: TGG
agtagtctttagttttaaaa

SEQ ID NO: 10916 - DNA, 20 bp, Artificial Sequence
  Description of Artificial Sequence: Synthetic oligonucleotide
  Target: SOD1; (+) strand; PAM type: NRG; PAM sequence: CAG
gtctttagttttaaaatggc

SEQ ID NO: 10917 - DNA, 20 bp, Artificial Sequence
  Description of Artificial Sequence: Synthetic oligonucleotide
  Target: SOD1; (+) strand; PAM type: NRG; PAM sequence: CAG
aaatggccagattttcttgc

SEQ ID NO: 10918 - DNA, 20 bp, Artificial Sequence
  Description of Artificial Sequence: Synthetic oligonucleotide
  Target: SOD1; (+) strand; PAM type: NRG; PAM sequence: AGG
aatggccagattttcttgcc

SEQ ID NO: 10919 - DNA, 20 bp, Artificial Sequence
  Description of Artificial Sequence: Synthetic oligonucleotide
  Target: SOD1; (+) strand; PAM type: NRG; PAM sequence: TGG
ccagattttcttgccaggat

SEQ ID NO: 10920 - DNA, 20 bp, Artificial Sequence
  Description of Artificial Sequence: Synthetic oligonucleotide
  Target: SOD1; (+) strand; PAM type: NRG; PAM sequence: GGG
cagattttcttgccaggatt

SEQ ID NO: 10921 - DNA, 20 bp, Artificial Sequence
  Description of Artificial Sequence: Synthetic oligonucleotide
  Target: SOD1; (+) strand; PAM type: NRG; PAM sequence: CAG
tgggtttctcacttgttaaa

SEQ ID NO: 10922 - DNA, 20 bp, Artificial Sequence
  Description of Artificial Sequence: Synthetic oligonucleotide
  Target: SOD1; (+) strand; PAM type: NRG; PAM sequence: AAG
gttaaacagaacattttgtt

SEQ ID NO: 10923 - DNA, 20 bp, Artificial Sequence
  Description of Artificial Sequence: Synthetic oligonucleotide
  Target: SOD1; (+) strand; PAM type: NRG; PAM sequence: TGG
attttgttaagtttaaaacc

SEQ ID NO: 10924 - DNA, 20 bp, Artificial Sequence
  Description of Artificial Sequence: Synthetic oligonucleotide
  Target: SOD1; (+) strand; PAM type: NRG; PAM sequence: GGG
ttttgttaagtttaaaacct

SEQ ID NO: 10925 - DNA, 20 bp, Artificial Sequence
  Description of Artificial Sequence: Synthetic oligonucleotide
  Target: SOD1; (+) strand; PAM type: NRG; PAM sequence: TGG
gttaagtttaaaacctggga

SEQ ID NO: 10926 - DNA, 20 bp, Artificial Sequence
  Description of Artificial Sequence: Synthetic oligonucleotide
  Target: SOD1; (+) strand; PAM type: NRG; PAM sequence: AAG
ttaaaacctgggatggactt

SEQ ID NO: 10927 - DNA, 20 bp, Artificial Sequence
  Description of Artificial Sequence: Synthetic oligonucleotide
  Target: SOD1; (+) strand; PAM type: NRG; PAM sequence: CAG
catgttcattcatgttcatt

SEQ ID NO: 10928 - DNA, 20 bp, Artificial Sequence
  Description of Artificial Sequence: Synthetic oligonucleotide
  Target: SOD1; (+) strand; PAM type: NRG; PAM sequence: AGG
atgttcattcatgttcattc

SEQ ID NO: 10929 - DNA, 20 bp, Artificial Sequence
  Description of Artificial Sequence: Synthetic oligonucleotide
  Target: SOD1; (+) strand; PAM type: NRG; PAM sequence: CAG
ttcatgttcattcaggactg

SEQ ID NO: 10930 - DNA, 20 bp, Artificial Sequence
  Description of Artificial Sequence: Synthetic oligonucleotide
  Target: SOD1; (+) strand; PAM type: NRG; PAM sequence: AGG
tcatgttcattcaggactgc

SEQ ID NO: 10931 - DNA, 20 bp, Artificial Sequence
  Description of Artificial Sequence: Synthetic oligonucleotide
  Target: SOD1; (+) strand; PAM type: NRG; PAM sequence: TGG
atcatgacttgtttaacttg

SEQ ID NO: 10932 - DNA, 20 bp, Artificial Sequence
  Description of Artificial Sequence: Synthetic oligonucleotide
  Target: SOD1; (+) strand; PAM type: NRG; PAM sequence: GGG
tcatgacttgtttaacttgt

SEQ ID NO: 10933 - DNA, 20 bp, Artificial Sequence
  Description of Artificial Sequence: Synthetic oligonucleotide
  Target: SOD1; (+) strand; PAM type: NRG; PAM sequence: AAG
tgacttgtttaacttgtggg

SEQ ID NO: 10934 - DNA, 20 bp, Artificial Sequence
  Description of Artificial Sequence: Synthetic oligonucleotide
  Target: SOD1; (+) strand; PAM type: NRG; PAM sequence: AAG
ttgtgggaagctgttgtccc

SEQ ID NO: 10935 - DNA, 20 bp, Artificial Sequence
  Description of Artificial Sequence: Synthetic oligonucleotide
  Target: SOD1; (+) strand; PAM type: NRG; PAM sequence: TGG
gctgttgtcccaagttatcc

SEQ ID NO: 10936 - DNA, 20 bp, Artificial Sequence
  Description of Artificial Sequence: Synthetic oligonucleotide
  Target: SOD1; (+) strand; PAM type: NRG; PAM sequence: GGG
ctgttgtcccaagttatcct

SEQ ID NO: 10937 - DNA, 20 bp, Artificial Sequence
  Description of Artificial Sequence: Synthetic oligonucleotide
  Target: SOD1; (+) strand; PAM type: NRG; PAM sequence: GGG
tgttgtcccaagttatcctg

SEQ ID NO: 10938 - DNA, 20 bp, Artificial Sequence
  Description of Artificial Sequence: Synthetic oligonucleotide
  Target: SOD1; (+) strand; PAM type: NRG; PAM sequence: TGG
ttatcctggggaactgcatc

SEQ ID NO: 10939 - DNA, 20 bp, Artificial Sequence
  Description of Artificial Sequence: Synthetic oligonucleotide
  Target: SOD1; (+) strand; PAM type: NRG; PAM sequence: AAG
tctggttcttgcaaaacacc

SEQ ID NO: 10940 - DNA, 20 bp, Artificial Sequence
  Description of Artificial Sequence: Synthetic oligonucleotide
  Target: SOD1; (+) strand; PAM type: NRG; PAM sequence: TAG
ggttcttgcaaaacaccaag

SEQ ID NO: 10941 - DNA, 20 bp, Artificial Sequence
  Description of Artificial Sequence: Synthetic oligonucleotide
  Target: SOD1; (+) strand; PAM type: NRG; PAM sequence: CAG
cttgcaaaacaccaagtaga

SEQ ID NO: 10942 - DNA, 20 bp, Artificial Sequence
  Description of Artificial Sequence: Synthetic oligonucleotide
  Target: SOD1; (+) strand; PAM type: NRG; PAM sequence: AGG
ttgcaaaacaccaagtagac

SEQ ID NO: 10943 - DNA, 20 bp, Artificial Sequence
  Description of Artificial Sequence: Synthetic oligonucleotide
  Target: SOD1; (+) strand; PAM type: NRG; PAM sequence: GAG
gctctcttttacctcccctt

SEQ ID NO: 10944 - DNA, 20 bp, Artificial Sequence
  Description of Artificial Sequence: Synthetic oligonucleotide
  Target: SOD1; (+) strand; PAM type: NRG; PAM sequence: AGG
ctctcttttacctccccttg

SEQ ID NO: 10945 - DNA, 20 bp, Artificial Sequence
  Description of Artificial Sequence: Synthetic oligonucleotide
  Target: SOD1; (+) strand; PAM type: NRG; PAM sequence: GGG
tctcttttacctccccttga

SEQ ID NO: 10946 - DNA, 20 bp, Artificial Sequence
  Description of Artificial Sequence: Synthetic oligonucleotide
  Target: SOD1; (+) strand; PAM type: NRG; PAM sequence: CAG
cccttgagggcattaacatt

SEQ ID NO: 10947 - DNA, 20 bp, Artificial Sequence
  Description of Artificial Sequence: Synthetic oligonucleotide
  Target: SOD1; (+) strand; PAM type: NRG; PAM sequence: TAG
ttgagggcattaacattcag

SEQ ID NO: 10948 - DNA, 20 bp, Artificial Sequence
  Description of Artificial Sequence: Synthetic oligonucleotide
  Target: SOD1; (+) strand; PAM type: NRG; PAM sequence: CAG
attcagtagtcacttccatt

SEQ ID NO: 10949 - DNA, 20 bp, Artificial Sequence
  Description of Artificial Sequence: Synthetic oligonucleotide
  Target: SOD1; (+) strand; PAM type: NRG; PAM sequence: TGG
cagttaaccctttattttta

SEQ ID NO: 10950 - DNA, 20 bp, Artificial Sequence
  Description of Artificial Sequence: Synthetic oligonucleotide
  Target: SOD1; (+) strand; PAM type: NRG; PAM sequence: GAG
ttatttttatggtttttctt

SEQ ID NO: 10951 - DNA, 20 bp, Artificial Sequence
  Description of Artificial Sequence: Synthetic oligonucleotide
  Target: SOD1; (+) strand; PAM type: NRG; PAM sequence: TAG
ttatggtttttcttgagcca

SEQ ID NO: 10952 - DNA, 20 bp, Artificial Sequence
  Description of Artificial Sequence: Synthetic oligonucleotide
  Target: SOD1; (+) strand; PAM type: NRG; PAM sequence: AAG
tttcttgagccatagttgta

SEQ ID NO: 10953 - DNA, 20 bp, Artificial Sequence
  Description of Artificial Sequence: Synthetic oligonucleotide
  Target: SOD1; (+) strand; PAM type: NRG; PAM sequence: CAG
cttgagccatagttgtaaag

SEQ ID NO: 10954 - DNA, 20 bp, Artificial Sequence
  Description of Artificial Sequence: Synthetic oligonucleotide
  Target: SOD1; (+) strand; PAM type: NRG; PAM sequence: AAG
aagcagaaaaatcatttata

SEQ ID NO: 10955 - DNA, 20 bp, Artificial Sequence
  Description of Artificial Sequence: Synthetic oligonucleotide
  Target: SOD1; (+) strand; PAM type: NRG; PAM sequence: AGG
agcagaaaaatcatttataa

SEQ ID NO: 10956 - DNA, 20 bp, Artificial Sequence
  Description of Artificial Sequence: Synthetic oligonucleotide
  Target: SOD1; (+) strand; PAM type: NRG; PAM sequence: AAG
attcaaaatactgttgctta

SEQ ID NO: 10957 - DNA, 20 bp, Artificial Sequence
  Description of Artificial Sequence: Synthetic oligonucleotide
  Target: SOD1; (+) strand; PAM type: NRG; PAM sequence: AAG
atactgttgcttaaagtatt

SEQ ID NO: 10958 - DNA, 20 bp, Artificial Sequence
  Description of Artificial Sequence: Synthetic oligonucleotide
  Target: SOD1; (+) strand; PAM type: NRG; PAM sequence: TAG
cttaaagtattaagattttt

SEQ ID NO: 10959 - DNA, 20 bp, Artificial Sequence
  Description of Artificial Sequence: Synthetic oligonucleotide
  Target: SOD1; (+) strand; PAM type: NRG; PAM sequence: AGG
ttaaagtattaagatttttt

SEQ ID NO: 10960 - DNA, 20 bp, Artificial Sequence
  Description of Artificial Sequence: Synthetic oligonucleotide
  Target: SOD1; (+) strand; PAM type: NRG; PAM sequence: TAG
ttaggattataccttactta

SEQ ID NO: 10961 - DNA, 20 bp, Artificial Sequence
  Description of Artificial Sequence: Synthetic oligonucleotide
  Target: SOD1; (+) strand; PAM type: NRG; PAM sequence: AGG
taggattataccttacttat

SEQ ID NO: 10962 - DNA, 20 bp, Artificial Sequence
  Description of Artificial Sequence: Synthetic oligonucleotide
  Target: SOD1; (+) strand; PAM type: NRG; PAM sequence: TGG
ttataggcccgtcattcatt

SEQ ID NO: 10963 - DNA, 20 bp, Artificial Sequence
  Description of Artificial Sequence: Synthetic oligonucleotide
  Target: SOD1; (+) strand; PAM type: NRG; PAM sequence: GAG
ttcatttggcatgaaatttt

SEQ ID NO: 10964 - DNA, 20 bp, Artificial Sequence
  Description of Artificial Sequence: Synthetic oligonucleotide
  Target: SOD1; (+) strand; PAM type: NRG; PAM sequence: AAG
ttcactttcctttttttcca

SEQ ID NO: 10965 - DNA, 20 bp, Artificial Sequence
  Description of Artificial Sequence: Synthetic oligonucleotide
  Target: SOD1; (+) strand; PAM type: NRG; PAM sequence: AAG
agcaattaaaaaaactgcca

SEQ ID NO: 10966 - DNA, 20 bp, Artificial Sequence
  Description of Artificial Sequence: Synthetic oligonucleotide
  Target: SOD1; (+) strand; PAM type: NRG; PAM sequence: AAG
attaaaaaaactgccaaagt

SEQ ID NO: 10967 - DNA, 20 bp, Artificial Sequence
  Description of Artificial Sequence: Synthetic oligonucleotide
  Target: SOD1; (+) strand; PAM type: NRG; PAM sequence: GAG
taaaaaaactgccaaagtaa

SEQ ID NO: 10968 - DNA, 20 bp, Artificial Sequence
  Description of Artificial Sequence: Synthetic oligonucleotide
  Target: SOD1; (+) strand; PAM type: NRG; PAM sequence: CGG
tgccaaagtaagagtgactg

SEQ ID NO: 10969 - DNA, 20 bp, Artificial Sequence
  Description of Artificial Sequence: Synthetic oligonucleotide
  Target: SOD1; (+) strand; PAM type: NRG; PAM sequence: AAG
gtaagagtgactgcggaact

SEQ ID NO: 10970 - DNA, 20 bp, Artificial Sequence
  Description of Artificial Sequence: Synthetic oligonucleotide
  Target: SOD1; (+) strand; PAM type: NRG; PAM sequence: AGG
taagagtgactgcggaacta

SEQ ID NO: 10971 - DNA, 20 bp, Artificial Sequence
  Description of Artificial Sequence: Synthetic oligonucleotide
  Target: SOD1; (+) strand; PAM type: NRG; PAM sequence: TGG
aaggttactgtaacttacca

SEQ ID NO: 10972 - DNA, 20 bp, Artificial Sequence
  Description of Artificial Sequence: Synthetic oligonucleotide
  Target: SOD1; (+) strand; PAM type: NRG; PAM sequence: GAG
ggttactgtaacttaccatg

SEQ ID NO: 10973 - DNA, 20 bp, Artificial Sequence
  Description of Artificial Sequence: Synthetic oligonucleotide
  Target: SOD1; (+) strand; PAM type: NRG; PAM sequence: AGG
gttactgtaacttaccatgg

SEQ ID NO: 10974 - DNA, 20 bp, Artificial Sequence
  Description of Artificial Sequence: Synthetic oligonucleotide
  Target: SOD1; (+) strand; PAM type: NRG; PAM sequence: AAG
gtaacttaccatggaggatt

SEQ ID NO: 10975 - DNA, 20 bp, Artificial Sequence
  Description of Artificial Sequence: Synthetic oligonucleotide
  Target: SOD1; (+) strand; PAM type: NRG; PAM sequence: AGG
taacttaccatggaggatta

SEQ ID NO: 10976 - DNA, 20 bp, Artificial Sequence
  Description of Artificial Sequence: Synthetic oligonucleotide
  Target: SOD1; (+) strand; PAM type: NRG; PAM sequence: GGG
aacttaccatggaggattaa

SEQ ID NO: 10977 - DNA, 20 bp, Artificial Sequence
  Description of Artificial Sequence: Synthetic oligonucleotide
  Target: SOD1; (+) strand; PAM type: NRG; PAM sequence: TAG
ttaccatggaggattaaggg

SEQ ID NO: 10978 - DNA, 20 bp, Artificial Sequence
  Description of Artificial Sequence: Synthetic oligonucleotide
  Target: SOD1; (+) strand; PAM type: NRG; PAM sequence: TGG
ggaggattaagggtagcgtg

SEQ ID NO: 10979 - DNA, 20 bp, Artificial Sequence
  Description of Artificial Sequence: Synthetic oligonucleotide
  Target: SOD1; (+) strand; PAM type: NRG; PAM sequence: TGG
ggattaagggtagcgtgtgg

SEQ ID NO: 10980 - DNA, 20 bp, Artificial Sequence
  Description of Artificial Sequence: Synthetic oligonucleotide
  Target: SOD1; (+) strand; PAM type: NRG; PAM sequence: TAG
gcgtgtggtggtctacaaca

SEQ ID NO: 10981 - DNA, 20 bp, Artificial Sequence
  Description of Artificial Sequence: Synthetic oligonucleotide
  Target: SOD1; (+) strand; PAM type: NRG; PAM sequence: TGG
tggtctacaacatagttatt

SEQ ID NO: 10982 - DNA, 20 bp, Artificial Sequence
  Description of Artificial Sequence: Synthetic oligonucleotide
  Target: SOD1; (+) strand; PAM type: NRG; PAM sequence: GGG
ggtctacaacatagttattt

SEQ ID NO: 10983 - DNA, 20 bp, Artificial Sequence
  Description of Artificial Sequence: Synthetic oligonucleotide
  Target: SOD1; (+) strand; PAM type: NRG; PAM sequence: TAG
caacatagttatttgggttt

SEQ ID NO: 10984 - DNA, 20 bp, Artificial Sequence
  Description of Artificial Sequence: Synthetic oligonucleotide
  Target: SOD1; (+) strand; PAM type: NRG; PAM sequence: TAG
ttgggttttagtatttcatt

SEQ ID NO: 10985 - DNA, 20 bp, Artificial Sequence
  Description of Artificial Sequence: Synthetic oligonucleotide
  Target: SOD1; (+) strand; PAM type: NRG; PAM sequence: CAG
gttttagtatttcatttaga

SEQ ID NO: 10986 - DNA, 20 bp, Artificial Sequence
  Description of Artificial Sequence: Synthetic oligonucleotide
  Target: SOD1; (+) strand; PAM type: NRG; PAM sequence: AAG
caacacttacctaatgttta

SEQ ID NO: 10987 - DNA, 20 bp, Artificial Sequence
  Description of Artificial Sequence: Synthetic oligonucleotide
  Target: SOD1; (+) strand; PAM type: NRG; PAM sequence: AGG
aacacttacctaatgtttaa

SEQ ID NO: 10988 - DNA, 20 bp, Artificial Sequence
  Description of Artificial Sequence: Synthetic oligonucleotide
  Target: SOD1; (+) strand; PAM type: NRG; PAM sequence: AAG
ggtaatgtctttgcaacacc

SEQ ID NO: 10989 - DNA, 20 bp, Artificial Sequence
  Description of Artificial Sequence: Synthetic oligonucleotide
  Target: SOD1; (+) strand; PAM type: NRG; PAM sequence: AAG
gtctttgcaacaccaagaaa

SEQ ID NO: 10990 - DNA, 20 bp, Artificial Sequence
  Description of Artificial Sequence: Synthetic oligonucleotide
  Target: SOD1; (+) strand; PAM type: NRG; PAM sequence: GAG
caacaccaagaaaaagcttt

SEQ ID NO: 10991 - DNA, 20 bp, Artificial Sequence
  Description of Artificial Sequence: Synthetic oligonucleotide
  Target: SOD1; (+) strand; PAM type: NRG; PAM sequence: TAG
caccaagaaaaagctttgag

SEQ ID NO: 10992 - DNA, 20 bp, Artificial Sequence
  Description of Artificial Sequence: Synthetic oligonucleotide
  Target: SOD1; (+) strand; PAM type: NRG; PAM sequence: TAG
caagaaaaagctttgagtag

SEQ ID NO: 10993 - DNA, 20 bp, Artificial Sequence
  Description of Artificial Sequence: Synthetic oligonucleotide
  Target: SOD1; (+) strand; PAM type: NRG; PAM sequence: TAG
acttttaaactactaaatat

SEQ ID NO: 10994 - DNA, 20 bp, Artificial Sequence
  Description of Artificial Sequence: Synthetic oligonucleotide
  Target: SOD1; (+) strand; PAM type: NRG; PAM sequence: TAG
atattagtatatctctctac

SEQ ID NO: 10995 - DNA, 20 bp, Artificial Sequence
  Description of Artificial Sequence: Synthetic oligonucleotide
  Target: SOD1; (+) strand; PAM type: NRG; PAM sequence: AGG
tattagtatatctctctact

SEQ ID NO: 10996 - DNA, 20 bp, Artificial Sequence
  Description of Artificial Sequence: Synthetic oligonucleotide
  Target: SOD1; (+) strand; PAM type: NRG; PAM sequence: GAG
tgttatttttctaatattat

SEQ ID NO: 10997 - DNA, 20 bp, Artificial Sequence
  Description of Artificial Sequence: Synthetic oligonucleotide
  Target: SOD1; (+) strand; PAM type: NRG; PAM sequence: AGG
gttatttttctaatattatg

SEQ ID NO: 10998 - DNA, 20 bp, Artificial Sequence
  Description of Artificial Sequence: Synthetic oligonucleotide
  Target: SOD1; (+) strand; PAM type: NRG; PAM sequence: TGG
tgaggttcttaaacatcttt

SEQ ID NO: 10999 - DNA, 20 bp, Artificial Sequence
  Description of Artificial Sequence: Synthetic oligonucleotide
  Target: SOD1; (+) strand; PAM type: NRG; PAM sequence: GGG
gaggttcttaaacatctttt

SEQ ID NO: 11000 - DNA, 20 bp, Artificial Sequence
  Description of Artificial Sequence: Synthetic oligonucleotide
  Target: SOD1; (+) strand; PAM type: NRG; PAM sequence: TGG
aaacatcttttgggtattgt

SEQ ID NO: 11001 - DNA, 20 bp, Artificial Sequence
  Description of Artificial Sequence: Synthetic oligonucleotide
  Target: SOD1; (+) strand; PAM type: NRG; PAM sequence: GGG
aacatcttttgggtattgtt

SEQ ID NO: 11002 - DNA, 20 bp, Artificial Sequence
  Description of Artificial Sequence: Synthetic oligonucleotide
  Target: SOD1; (+) strand; PAM type: NRG; PAM sequence: GAG
catcttttgggtattgttgg

SEQ ID NO: 11003 - DNA, 20 bp, Artificial Sequence
  Description of Artificial Sequence: Synthetic oligonucleotide
  Target: SOD1; (+) strand; PAM type: NRG; PAM sequence: AGG
atcttttgggtattgttggg

SEQ ID NO: 11004 - DNA, 20 bp, Artificial Sequence
  Description of Artificial Sequence: Synthetic oligonucleotide
  Target: SOD1; (+) strand; PAM type: NRG; PAM sequence: GAG
cttttgggtattgttgggag

SEQ ID NO: 11005 - DNA, 20 bp, Artificial Sequence
  Description of Artificial Sequence: Synthetic oligonucleotide
  Target: SOD1; (+) strand; PAM type: NRG; PAM sequence: AGG
ttttgggtattgttgggagg

SEQ ID NO: 11006 - DNA, 20 bp, Artificial Sequence
  Description of Artificial Sequence: Synthetic oligonucleotide
  Target: SOD1; (+) strand; PAM type: NRG; PAM sequence: TAG
tgggtattgttgggaggagg

SEQ ID NO: 11007 - DNA, 20 bp, Artificial Sequence
  Description of Artificial Sequence: Synthetic oligonucleotide
  Target: SOD1; (+) strand; PAM type: NRG; PAM sequence: CAG
aggaggtagtgattacttga

SEQ ID NO: 11008 - DNA, 20 bp, Artificial Sequence
  Description of Artificial Sequence: Synthetic oligonucleotide
  Target: SOD1; (+) strand; PAM type: NRG; PAM sequence: AAG
agtgattacttgacagccca

SEQ ID NO: 11009 - DNA, 20 bp, Artificial Sequence
  Description of Artificial Sequence: Synthetic oligonucleotide
  Target: SOD1; (+) strand; PAM type: NRG; PAM sequence: CAG
tatcttcttaaaatttttta

SEQ ID NO: 11010 - DNA, 20 bp, Artificial Sequence
  Description of Artificial Sequence: Synthetic oligonucleotide
  Target: SOD1; (+) strand; PAM type: NRG; PAM sequence: AGG
atcttcttaaaattttttac

SEQ ID NO: 11011 - DNA, 20 bp, Artificial Sequence
  Description of Artificial Sequence: Synthetic oligonucleotide
  Target: SOD1; (+) strand; PAM type: NRG; PAM sequence: AAG
ttttttacaggtccatgaaa

SEQ ID NO: 11012 - DNA, 20 bp, Artificial Sequence
  Description of Artificial Sequence: Synthetic oligonucleotide
  Target: SOD1; (+) strand; PAM type: NRG; PAM sequence: CAG
tttacaggtccatgaaaaag

SEQ ID NO: 11013 - DNA, 20 bp, Artificial Sequence
  Description of Artificial Sequence: Synthetic oligonucleotide
  Target: SOD1; (+) strand; PAM type: NRG; PAM sequence: TGG
ccatgaaaaagcagatgact

SEQ ID NO: 11014 - DNA, 20 bp, Artificial Sequence
  Description of Artificial Sequence: Synthetic oligonucleotide
  Target: SOD1; (+) strand; PAM type: NRG; PAM sequence: GGG
catgaaaaagcagatgactt

SEQ ID NO: 11015 - DNA, 20 bp, Artificial Sequence
  Description of Artificial Sequence: Synthetic oligonucleotide
  Target: SOD1; (+) strand; PAM type: NRG; PAM sequence: AAG
aaaagcagatgacttgggca

SEQ ID NO: 11016 - DNA, 20 bp, Artificial Sequence
  Description of Artificial Sequence: Synthetic oligonucleotide
  Target: SOD1; (+) strand; PAM type: NRG; PAM sequence: AGG
aaagcagatgacttgggcaa

SEQ ID NO: 11017 - DNA, 20 bp, Artificial Sequence
  Description of Artificial Sequence: Synthetic oligonucleotide
  Target: SOD1; (+) strand; PAM type: NRG; PAM sequence: TGG
gcagatgacttgggcaaagg

SEQ ID NO: 11018 - DNA, 20 bp, Artificial Sequence
  Description of Artificial Sequence: Synthetic oligonucleotide
  Target: SOD1; (+) strand; PAM type: NRG; PAM sequence: AAG
cttgggcaaaggtggaaatg

SEQ ID NO: 11019 - DNA, 20 bp, Artificial Sequence
  Description of Artificial Sequence: Synthetic oligonucleotide
  Target: SOD1; (+) strand; PAM type: NRG; PAM sequence: AAG
ggcaaaggtggaaatgaaga

SEQ ID NO: 11020 - DNA, 20 bp, Artificial Sequence
  Description of Artificial Sequence: Synthetic oligonucleotide
  Target: SOD1; (+) strand; PAM type: NRG; PAM sequence: AAG
gtggaaatgaagaaagtaca

SEQ ID NO: 11021 - DNA, 20 bp, Artificial Sequence
  Description of Artificial Sequence: Synthetic oligonucleotide
  Target: SOD1; (+) strand; PAM type: NRG; PAM sequence: CAG
aaatgaagaaagtacaaaga

SEQ ID NO: 11022 - DNA, 20 bp, Artificial Sequence
  Description of Artificial Sequence: Synthetic oligonucleotide
  Target: SOD1; (+) strand; PAM type: NRG; PAM sequence: AGG
aatgaagaaagtacaaagac

SEQ ID NO: 11023 - DNA, 20 bp, Artificial Sequence
  Description of Artificial Sequence: Synthetic oligonucleotide
  Target: SOD1; (+) strand; PAM type: NRG; PAM sequence: TGG
agtacaaagacaggaaacgc

SEQ ID NO: 11024 - DNA, 20 bp, Artificial Sequence
  Description of Artificial Sequence: Synthetic oligonucleotide
  Target: SOD1; (+) strand; PAM type: NRG; PAM sequence: AAG
acaaagacaggaaacgctgg

SEQ ID NO: 11025 - DNA, 20 bp, Artificial Sequence
  Description of Artificial Sequence: Synthetic oligonucleotide
  Target: SOD1; (+) strand; PAM type: NRG; PAM sequence: TGG
aggaaacgctggaagtcgtt

SEQ ID NO: 11026 - DNA, 20 bp, Artificial Sequence
  Description of Artificial Sequence: Synthetic oligonucleotide
  Target: SOD1; (+) strand; PAM type: NRG; PAM sequence: TGG
gctggaagtcgtttggcttg

SEQ ID NO: 11027 - DNA, 20 bp, Artificial Sequence
  Description of Artificial Sequence: Synthetic oligonucleotide
  Target: SOD1; (+) strand; PAM type: NRG; PAM sequence: TGG
cgtttggcttgtggtgtaat

SEQ ID NO: 11028 - DNA, 20 bp, Artificial Sequence
  Description of Artificial Sequence: Synthetic oligonucleotide
  Target: SOD1; (+) strand; PAM type: NRG; PAM sequence: GGG
gtttggcttgtggtgtaatt

SEQ ID NO: 11029 - DNA, 20 bp, Artificial Sequence
  Description of Artificial Sequence: Synthetic oligonucleotide
  Target: SOD1; (+) strand; PAM type: NRG; PAM sequence: TGG
tcgcccaataaacattccct

SEQ ID NO: 11030 - DNA, 20 bp, Artificial Sequence
  Description of Artificial Sequence: Synthetic oligonucleotide
  Target: SOD1; (+) strand; PAM type: NRG; PAM sequence: TAG
aataaacattcccttggatg

SEQ ID NO: 11031 - DNA, 20 bp, Artificial Sequence
  Description of Artificial Sequence: Synthetic oligonucleotide
  Target: SOD1; (+) strand; PAM type: NRG; PAM sequence: GAG
cattcccttggatgtagtct

SEQ ID NO: 11032 - DNA, 20 bp, Artificial Sequence
  Description of Artificial Sequence: Synthetic oligonucleotide
  Target: SOD1; (+) strand; PAM type: NRG; PAM sequence: AGG
attcccttggatgtagtctg

SEQ ID NO: 11033 - DNA, 20 bp, Artificial Sequence
  Description of Artificial Sequence: Synthetic oligonucleotide
  Target: SOD1; (+) strand; PAM type: NRG; PAM sequence: TAG
taactcatctgttatcctgc

SEQ ID NO: 11034 - DNA, 20 bp, Artificial Sequence
  Description of Artificial Sequence: Synthetic oligonucleotide
  Target: SOD1; (+) strand; PAM type: NRG; PAM sequence: TAG
atctgttatcctgctagctg

SEQ ID NO: 11035 - DNA, 20 bp, Artificial Sequence
  Description of Artificial Sequence: Synthetic oligonucleotide
  Target: SOD1; (+) strand; PAM type: NRG; PAM sequence: AAG
attaaacactgtaatcttaa

SEQ ID NO: 11036 - DNA, 20 bp, Artificial Sequence
  Description of Artificial Sequence: Synthetic oligonucleotide
  Target: SOD1; (+) strand; PAM type: NRG; PAM sequence: CAG
gtgtaattgtgtgacttttt

SEQ ID NO: 11037 - DNA, 20 bp, Artificial Sequence
  Description of Artificial Sequence: Synthetic oligonucleotide
  Target: SOD1; (+) strand; PAM type: NRG; PAM sequence: GAG
gtaattgtgtgactttttca

SEQ ID NO: 11038 - DNA, 20 bp, Artificial Sequence
  Description of Artificial Sequence: Synthetic oligonucleotide
  Target: SOD1; (+) strand; PAM type: NRG; PAM sequence: AAG
actttttcagagttgcttta

SEQ ID NO: 11039 - DNA, 20 bp, Artificial Sequence
  Description of Artificial Sequence: Synthetic oligonucleotide
  Target: SOD1; (+) strand; PAM type: NRG; PAM sequence: TAG
gagttgctttaaagtacctg

SEQ ID NO: 11040 - DNA, 20 bp, Artificial Sequence
  Description of Artificial Sequence: Synthetic oligonucleotide
  Target: SOD1; (+) strand; PAM type: NRG; PAM sequence: GAG
tgctttaaagtacctgtagt

SEQ ID NO: 11041 - DNA, 20 bp, Artificial Sequence
  Description of Artificial Sequence: Synthetic oligonucleotide
  Target: SOD1; (+) strand; PAM type: NRG; PAM sequence: TGG
gaaactgatttatgatcact

SEQ ID NO: 11042 - DNA, 20 bp, Artificial Sequence
  Description of Artificial Sequence: Synthetic oligonucleotide
  Target: SOD1; (+) strand; PAM type: NRG; PAM sequence: AAG
actgatttatgatcacttgg

SEQ ID NO: 11043 - DNA, 20 bp, Artificial Sequence
  Description of Artificial Sequence: Synthetic oligonucleotide
  Target: SOD1; (+) strand; PAM type: NRG; PAM sequence: TAG
gatcacttggaagatttgta

SEQ ID NO: 11044 - DNA, 20 bp, Artificial Sequence
  Description of Artificial Sequence: Synthetic oligonucleotide
  Target: SOD1; (+) strand; PAM type: NRG; PAM sequence: CAG
ttgtatagttttataaaact

SEQ ID NO: 11045 - DNA, 20 bp, Artificial Sequence
  Description of Artificial Sequence: Synthetic oligonucleotide
  Target: SOD1; (+) strand; PAM type: NRG; PAM sequence: CAG
ttcaatgacctgtattttgc

SEQ ID NO: 11046 - DNA, 20 bp, Artificial Sequence
  Description of Artificial Sequence: Synthetic oligonucleotide
  Target: SOD1; (+) strand; PAM type: NRG; PAM sequence: CAG
attttgccagacttaaatca

SEQ ID NO: 11047 - DNA, 20 bp, Artificial Sequence
  Description of Artificial Sequence: Synthetic oligonucleotide
  Target: SOD1; (+) strand; PAM type: NRG; PAM sequence: TGG
tgccagacttaaatcacaga

SEQ ID NO: 11048 - DNA, 20 bp, Artificial Sequence
  Description of Artificial Sequence: Synthetic oligonucleotide
  Target: SOD1; (+) strand; PAM type: NRG; PAM sequence: GGG
gccagacttaaatcacagat

SEQ ID NO: 11049 - DNA, 20 bp, Artificial Sequence
  Description of Artificial Sequence: Synthetic oligonucleotide
  Target: SOD1; (+) strand; PAM type: NRG; PAM sequence: CAG
cagatgggtattaaacttgt

SEQ ID NO: 11050 - DNA, 20 bp, Artificial Sequence
  Description of Artificial Sequence: Synthetic oligonucleotide
  Target: SOD1; (+) strand; PAM type: NRG; PAM sequence: AAG
tcagaatttctttgtcattc

SEQ ID NO: 11051 - DNA, 20 bp, Artificial Sequence
  Description of Artificial Sequence: Synthetic oligonucleotide
  Target: SOD1; (+) strand; PAM type: NRG; PAM sequence: TGG
ctgtgaataaaaaccctgta

SEQ ID NO: 11052 - DNA, 20 bp, Artificial Sequence
  Description of Artificial Sequence: Synthetic oligonucleotide
  Target: SOD1; (+) strand; PAM type: NRG; PAM sequence: GAG
ccctgtatggcacttattat

SEQ ID NO: 11053 - DNA, 20 bp, Artificial Sequence
  Description of Artificial Sequence: Synthetic oligonucleotide
  Target: SOD1; (+) strand; PAM type: NRG; PAM sequence: AGG
cctgtatggcacttattatg

SEQ ID NO: 11054 - DNA, 20 bp, Artificial Sequence
  Description of Artificial Sequence: Synthetic oligonucleotide
  Target: SOD1; (+) strand; PAM type: NRG; PAM sequence: AAG
acttattatgaggctattaa

SEQ ID NO: 11055 - DNA, 20 bp, Artificial Sequence
  Description of Artificial Sequence: Synthetic oligonucleotide
  Target: SOD1; (+) strand; PAM type: NRG; PAM sequence: TAG
aatccaaattcaaactaaat

SEQ ID NO: 11056 - DNA, 20 bp, Artificial Sequence
  Description of Artificial Sequence: Synthetic oligonucleotide
  Target: SOD1; (+) strand; PAM type: NRG; PAM sequence: CAG
ctgatacttatttatataaa

SEQ ID NO: 11057 - DNA, 20 bp, Artificial Sequence
  Description of Artificial Sequence: Synthetic oligonucleotide
  Target: SOD1; (+) strand; PAM type: NRG; PAM sequence: CAG
cttatttatataaacagctt

SEQ ID NO: 11058 - DNA, 20 bp, Artificial Sequence
  Description of Artificial Sequence: Synthetic oligonucleotide
  Target: SOD1; (+) strand; PAM type: NRG; PAM sequence: TGG
atttatataaacagcttcag

SEQ ID NO: 11059 - DNA, 20 bp, Artificial Sequence
  Description of Artificial Sequence: Synthetic oligonucleotide
  Target: SOD1; (+) strand; PAM type: NRG; PAM sequence: CAG
tataaacagcttcagtggaa

SEQ ID NO: 11060 - DNA, 20 bp, Artificial Sequence
  Description of Artificial Sequence: Synthetic oligonucleotide
  Target: SOD1; (+) strand; PAM type: NRG; PAM sequence: TAG
cagcttcagtggaacagatt

SEQ ID NO: 11061 - DNA, 20 bp, Artificial Sequence
  Description of Artificial Sequence: Synthetic oligonucleotide
  Target: SOD1; (+) strand; PAM type: NRG; PAM sequence: CAG
aacagatttagtaatactaa

SEQ ID NO: 11062 - DNA, 20 bp, Artificial Sequence
  Description of Artificial Sequence: Synthetic oligonucleotide
  Target: SOD1; (+) strand; PAM type: NRG; PAM sequence: TAG
tttagtaatactaacagtga

SEQ ID NO: 11063 - DNA, 20 bp, Artificial Sequence
  Description of Artificial Sequence: Synthetic oligonucleotide
  Target: SOD1; (+) strand; PAM type: NRG; PAM sequence: AAG
gtgatagcattttattttga

SEQ ID NO: 11064 - DNA, 20 bp, Artificial Sequence
  Description of Artificial Sequence: Synthetic oligonucleotide
  Target: SOD1; (+) strand; PAM type: NRG; PAM sequence: GAG
ttttattttgaaagtgtttt

SEQ ID NO: 11065 - DNA, 20 bp, Artificial Sequence
  Description of Artificial Sequence: Synthetic oligonucleotide
  Target: SOD1; (+) strand; PAM type: NRG; PAM sequence: CAG
tcaaaatgcatactttaaaa

SEQ ID NO: 11066 - DNA, 20 bp, Artificial Sequence
  Description of Artificial Sequence: Synthetic oligonucleotide
  Target: SOD1; (+) strand; PAM type: NRG; PAM sequence: CAG
aaatgcatactttaaaacag

SEQ ID NO: 11067 - DNA, 20 bp, Artificial Sequence
  Description of Artificial Sequence: Synthetic oligonucleotide
  Target: SOD1; (+) strand; PAM type: NRG; PAM sequence: AGG
aatgcatactttaaaacagc

SEQ ID NO: 11068 - DNA, 20 bp, Artificial Sequence
  Description of Artificial Sequence: Synthetic oligonucleotide
  Target: SOD1; (+) strand; PAM type: NRG; PAM sequence: TAG
ctttaaaacagcaggtcttt

SEQ ID NO: 11069 - DNA, 20 bp, Artificial Sequence
  Description of Artificial Sequence: Synthetic oligonucleotide
  Target: SOD1; (+) strand; PAM type: NRG; PAM sequence: TAG
aaaactaacacaactctgct

SEQ ID NO: 11070 - DNA, 20 bp, Artificial Sequence
  Description of Artificial Sequence: Synthetic oligonucleotide
  Target: SOD1; (+) strand; PAM type: NRG; PAM sequence: TAG
cacaactctgcttagacaaa

SEQ ID NO: 11071 - DNA, 20 bp, Artificial Sequence
  Description of Artificial Sequence: Synthetic oligonucleotide
  Target: SOD1; (+) strand; PAM type: NRG; PAM sequence: AGG
acaactctgcttagacaaat

SEQ ID NO: 11072 - DNA, 20 bp, Artificial Sequence
  Description of Artificial Sequence: Synthetic oligonucleotide
  Target: SOD1; (+) strand; PAM type: NRG; PAM sequence: AAG
acaaataggctgtcctttga

SEQ ID NO: 11073 - DNA, 20 bp, Artificial Sequence
  Description of Artificial Sequence: Synthetic oligonucleotide
  Target: SOD1; (+) strand; PAM type: NRG; PAM sequence: TAG
aggctgtcctttgaaagctt

SEQ ID NO: 11074 - DNA, 20 bp, Artificial Sequence
  Description of Artificial Sequence: Synthetic oligonucleotide
  Target: SOD1; (+) strand; PAM type: NRG; PAM sequence: AGG
ggctgtcctttgaaagcttt

SEQ ID NO: 11075 - DNA, 20 bp, Artificial Sequence
  Description of Artificial Sequence: Synthetic oligonucleotide
  Target: SOD1; (+) strand; PAM type: NRG; PAM sequence: GGG
gctgtcctttgaaagcttta

SEQ ID NO: 11076 - DNA, 20 bp, Artificial Sequence
  Description of Artificial Sequence: Synthetic oligonucleotide
  Target: SOD1; (+) strand; PAM type: NRG; PAM sequence: TAG
tttagggaaatgttcctgct

SEQ ID NO: 11077 - DNA, 20 bp, Artificial Sequence
  Description of Artificial Sequence: Synthetic oligonucleotide
  Target: SOD1; (+) strand; PAM type: NRG; PAM sequence: TAG
atgttcctgcttagtcattt

SEQ ID NO: 11078 - DNA, 20 bp, Artificial Sequence
  Description of Artificial Sequence: Synthetic oligonucleotide
  Target: SOD1; (+) strand; PAM type: NRG; PAM sequence: AAG
ttttagcattttgattcata

SEQ ID NO: 11079 - DNA, 20 bp, Artificial Sequence
  Description of Artificial Sequence: Synthetic oligonucleotide
  Target: SOD1; (+) strand; PAM type: NRG; PAM sequence: AAG
aagtacctcctcattttaaa

SEQ ID NO: 11080 - DNA, 20 bp, Artificial Sequence
  Description of Artificial Sequence: Synthetic oligonucleotide
  Target: SOD1; (+) strand; PAM type: NRG; PAM sequence: AAG
ttaaaaagacattatgatgt

SEQ ID NO: 11081 - DNA, 20 bp, Artificial Sequence
  Description of Artificial Sequence: Synthetic oligonucleotide
  Target: SOD1; (+) strand; PAM type: NRG; PAM sequence: GAG
aaaaagacattatgatgtaa

SEQ ID NO: 11082 - DNA, 20 bp, Artificial Sequence
  Description of Artificial Sequence: Synthetic oligonucleotide
  Target: SOD1; (+) strand; PAM type: NRG; PAM sequence: GAG
aaagacattatgatgtaaga

SEQ ID NO: 11083 - DNA, 20 bp, Artificial Sequence
  Description of Artificial Sequence: Synthetic oligonucleotide
  Target: SOD1; (+) strand; PAM type: NRG; PAM sequence: TAG
agagccatttgataactttt

SEQ ID NO: 11084 - DNA, 20 bp, Artificial Sequence
  Description of Artificial Sequence: Synthetic oligonucleotide
  Target: SOD1; (+) strand; PAM type: NRG; PAM sequence: GAG
ccatttgataactttttagt

SEQ ID NO: 11085 - DNA, 20 bp, Artificial Sequence
  Description of Artificial Sequence: Synthetic oligonucleotide
  Target: SOD1; (+) strand; PAM type: NRG; PAM sequence: AAG
aactttttagtgagctttga

SEQ ID NO: 11086 - DNA, 20 bp, Artificial Sequence
  Description of Artificial Sequence: Synthetic oligonucleotide
  Target: SOD1; (+) strand; PAM type: NRG; PAM sequence: AGG
actttttagtgagctttgaa

SEQ ID NO: 11087 - DNA, 20 bp, Artificial Sequence
  Description of Artificial Sequence: Synthetic oligonucleotide
  Target: SOD1; (+) strand; PAM type: NRG; PAM sequence: AAG
tttagtgagctttgaaaggc

SEQ ID NO: 11088 - DNA, 20 bp, Artificial Sequence
  Description of Artificial Sequence: Synthetic oligonucleotide
  Target: SOD1; (+) strand; PAM type: NRG; PAM sequence: CAG
gagctttgaaaggcaagtta

SEQ ID NO: 11089 - DNA, 20 bp, Artificial Sequence
  Description of Artificial Sequence: Synthetic oligonucleotide
  Target: SOD1; (+) strand; PAM type: NRG; PAM sequence: CAG
tgaaaggcaagttacagcct

SEQ ID NO: 11090 - DNA, 20 bp, Artificial Sequence
  Description of Artificial Sequence: Synthetic oligonucleotide
  Target: SOD1; (+) strand; PAM type: NRG; PAM sequence: TAG
aggcaagttacagcctcagc

SEQ ID NO: 11091 - DNA, 20 bp, Artificial Sequence
  Description of Artificial Sequence: Synthetic oligonucleotide
  Target: SOD1; (+) strand; PAM type: NRG; PAM sequence: TAG
aagttacagcctcagctagc

SEQ ID NO: 11092 - DNA, 20 bp, Artificial Sequence
  Description of Artificial Sequence: Synthetic oligonucleotide
  Target: SOD1; (+) strand; PAM type: NRG; PAM sequence: AAG
tacagcctcagctagctagt

SEQ ID NO: 11093 - DNA, 20 bp, Artificial Sequence
  Description of Artificial Sequence: Synthetic oligonucleotide
  Target: SOD1; (+) strand; PAM type: NRG; PAM sequence: CAG
tagtaagattatctacctgc

SEQ ID NO: 11094 - DNA, 20 bp, Artificial Sequence
  Description of Artificial Sequence: Synthetic oligonucleotide
  Target: SOD1; (+) strand; PAM type: NRG; PAM sequence: TGG
agattatctacctgccagaa

SEQ ID NO: 11095 - DNA, 20 bp, Artificial Sequence
  Description of Artificial Sequence: Synthetic oligonucleotide
  Target: SOD1; (+) strand; PAM type: NRG; PAM sequence: AAG
atggcacaaattctacattc

SEQ ID NO: 11096 - DNA, 20 bp, Artificial Sequence
  Description of Artificial Sequence: Synthetic oligonucleotide
  Target: SOD1; (+) strand; PAM type: NRG; PAM sequence: AGG
tggcacaaattctacattca

SEQ ID NO: 11097 - DNA, 20 bp, Artificial Sequence
  Description of Artificial Sequence: Synthetic oligonucleotide
  Target: SOD1; (+) strand; PAM type: NRG; PAM sequence: GGG
ggcacaaattctacattcaa

SEQ ID NO: 11098 - DNA, 20 bp, Artificial Sequence
  Description of Artificial Sequence: Synthetic oligonucleotide
  Target: SOD1; (+) strand; PAM type: NRG; PAM sequence: TAG
acaaattctacattcaaggg

SEQ ID NO: 11099 - DNA, 20 bp, Artificial Sequence
  Description of Artificial Sequence: Synthetic oligonucleotide
  Target: SOD1; (+) strand; PAM type: NRG; PAM sequence: TGG
ctacattcaagggtagacgc

SEQ ID NO: 11100 - DNA, 20 bp, Artificial Sequence
  Description of Artificial Sequence: Synthetic oligonucleotide
  Target: SOD1; (+) strand; PAM type: NRG; PAM sequence: CAG
acgctggcacaacctactta

SEQ ID NO: 11101 - DNA, 20 bp, Artificial Sequence
  Description of Artificial Sequence: Synthetic oligonucleotide
  Target: SOD1; (+) strand; PAM type: NRG; PAM sequence: TAG
ggcacaacctacttacagat

SEQ ID NO: 11102 - DNA, 20 bp, Artificial Sequence
  Description of Artificial Sequence: Synthetic oligonucleotide
  Target: SOD1; (+) strand; PAM type: NRG; PAM sequence: AAG
acttacagattagcccttta

SEQ ID NO: 11103 - DNA, 20 bp, Artificial Sequence
  Description of Artificial Sequence: Synthetic oligonucleotide
  Target: SOD1; (+) strand; PAM type: NRG; PAM sequence: TAG
tagccctttaaagcaatctg

SEQ ID NO: 11104 - DNA, 20 bp, Artificial Sequence
  Description of Artificial Sequence: Synthetic oligonucleotide
  Target: SOD1; (+) strand; PAM type: NRG; PAM sequence: TAG
tttaaagcaatctgtagcat

SEQ ID NO: 11105 - DNA, 20 bp, Artificial Sequence
  Description of Artificial Sequence: Synthetic oligonucleotide
  Target: SOD1; (+) strand; PAM type: NRG; PAM sequence: AAG
aaagcaatctgtagcattag

SEQ ID NO: 11106 - DNA, 20 bp, Artificial Sequence
  Description of Artificial Sequence: Synthetic oligonucleotide
  Target: SOD1; (+) strand; PAM type: NRG; PAM sequence: TGG
caatctgtagcattagaaga

SEQ ID NO: 11107 - DNA, 20 bp, Artificial Sequence
  Description of Artificial Sequence: Synthetic oligonucleotide
  Target: SOD1; (+) strand; PAM type: NRG; PAM sequence: AAG
tagcattagaagatggaacc

SEQ ID NO: 11108 - DNA, 20 bp, Artificial Sequence
  Description of Artificial Sequence: Synthetic oligonucleotide
  Target: SOD1; (+) strand; PAM type: NRG; PAM sequence: AGG
agcattagaagatggaacca

SEQ ID NO: 11109 - DNA, 20 bp, Artificial Sequence
  Description of Artificial Sequence: Synthetic oligonucleotide
  Target: SOD1; (+) strand; PAM type: NRG; PAM sequence: TGG
accaaggaaatgtttgactg

SEQ ID NO: 11110 - DNA, 20 bp, Artificial Sequence
  Description of Artificial Sequence: Synthetic oligonucleotide
  Target: SOD1; (+) strand; PAM type: NRG; PAM sequence: GGG
ccaaggaaatgtttgactgt

SEQ ID NO: 11111 - DNA, 20 bp, Artificial Sequence
  Description of Artificial Sequence: Synthetic oligonucleotide
  Target: SOD1; (+) strand; PAM type: NRG; PAM sequence: TGG
aaatgtttgactgtgggttc

SEQ ID NO: 11112 - DNA, 20 bp, Artificial Sequence
  Description of Artificial Sequence: Synthetic oligonucleotide
  Target: SOD1; (+) strand; PAM type: NRG; PAM sequence: GAG
gactgtgggttctggctgtt

SEQ ID NO: 11113 - DNA, 20 bp, Artificial Sequence
  Description of Artificial Sequence: Synthetic oligonucleotide
  Target: SOD1; (+) strand; PAM type: NRG; PAM sequence: TAG
aaataatttacacaccgaat

SEQ ID NO: 11114 - DNA, 20 bp, Artificial Sequence
  Description of Artificial Sequence: Synthetic oligonucleotide
  Target: SOD1; (+) strand; PAM type: NRG; PAM sequence: GAG
acacaccgaattagtgaaat

SEQ ID NO: 11115 - DNA, 20 bp, Artificial Sequence
  Description of Artificial Sequence: Synthetic oligonucleotide
  Target: SOD1; (+) strand; PAM type: NRG; PAM sequence: GAG
cttaatgtatttatgtacct

SEQ ID NO: 11116 - DNA, 20 bp, Artificial Sequence
  Description of Artificial Sequence: Synthetic oligonucleotide
  Target: SOD1; (+) strand; PAM type: NRG; PAM sequence: GAG
taatgtatttatgtacctga

SEQ ID NO: 11117 - DNA, 20 bp, Artificial Sequence
  Description of Artificial Sequence: Synthetic oligonucleotide
  Target: SOD1; (+) strand; PAM type: NRG; PAM sequence: CAG
ttttcaatgttaacctaact

SEQ ID NO: 11118 - DNA, 20 bp, Artificial Sequence
  Description of Artificial Sequence: Synthetic oligonucleotide
  Target: SOD1; (+) strand; PAM type: NRG; PAM sequence: AGG
tttcaatgttaacctaactc

SEQ ID NO: 11119 - DNA, 20 bp, Artificial Sequence
  Description of Artificial Sequence: Synthetic oligonucleotide
  Target: SOD1; (+) strand; PAM type: NRG; PAM sequence: TGG
gtttgactaaattattcaat

SEQ ID NO: 11120 - DNA, 20 bp, Artificial Sequence
  Description of Artificial Sequence: Synthetic oligonucleotide
  Target: SOD1; (+) strand; PAM type: NRG; PAM sequence: TAG
aattattcaattggaaattg

SEQ ID NO: 11121 - DNA, 20 bp, Artificial Sequence
  Description of Artificial Sequence: Synthetic oligonucleotide
  Target: SOD1; (+) strand; PAM type: NRG; PAM sequence: CAG
gaatattatttctgataaac

SEQ ID NO: 11122 - DNA, 20 bp, Artificial Sequence
  Description of Artificial Sequence: Synthetic oligonucleotide
  Target: SOD1; (+) strand; PAM type: NRG; PAM sequence: AAG
atttctgataaaccagaaat

SEQ ID NO: 11123 - DNA, 20 bp, Artificial Sequence
  Description of Artificial Sequence: Synthetic oligonucleotide
  Target: SOD1; (+) strand; PAM type: NRG; PAM sequence: TAG
aatatgtactttatcaaatg

SEQ ID NO: 11124 - DNA, 20 bp, Artificial Sequence
  Description of Artificial Sequence: Synthetic oligonucleotide
  Target: SOD1; (+) strand; PAM type: NRG; PAM sequence: AGG
atatgtactttatcaaatgt

SEQ ID NO: 11125 - DNA, 20 bp, Artificial Sequence
  Description of Artificial Sequence: Synthetic oligonucleotide
  Target: SOD1; (+) strand; PAM type: NRG; PAM sequence: GAG
atgtactttatcaaatgtag

SEQ ID NO: 11126 - DNA, 20 bp, Artificial Sequence
  Description of Artificial Sequence: Synthetic oligonucleotide
  Target: SOD1; (+) strand; PAM type: NRG; PAM sequence: GAG
gtactttatcaaatgtagga

SEQ ID NO: 11127 - DNA, 20 bp, Artificial Sequence
  Description of Artificial Sequence: Synthetic oligonucleotide
  Target: SOD1; (+) strand; PAM type: NRG; PAM sequence: TAG
caaatgtaggagagatcatt

SEQ ID NO: 11128 - DNA, 20 bp, Artificial Sequence
  Description of Artificial Sequence: Synthetic oligonucleotide
  Target: SOD1; (+) strand; PAM type: NRG; PAM sequence: AGG
aaatgtaggagagatcattt

SEQ ID NO: 11129 - DNA, 20 bp, Artificial Sequence
  Description of Artificial Sequence: Synthetic oligonucleotide
  Target: SOD1; (+) strand; PAM type: NRG; PAM sequence: GAG
atgtaggagagatcatttag

SEQ ID NO: 11130 - DNA, 20 bp, Artificial Sequence
  Description of Artificial Sequence: Synthetic oligonucleotide
  Target: SOD1; (+) strand; PAM type: NRG; PAM sequence: GAG
gtaggagagatcatttagga

SEQ ID NO: 11131 - DNA, 20 bp, Artificial Sequence
  Description of Artificial Sequence: Synthetic oligonucleotide
  Target: SOD1; (+) strand; PAM type: NRG; PAM sequence: AGG
taggagagatcatttaggag

SEQ ID NO: 11132 - DNA, 20 bp, Artificial Sequence
  Description of Artificial Sequence: Synthetic oligonucleotide
  Target: SOD1; (+) strand; PAM type: NRG; PAM sequence: AAG
gagatcatttaggagaggaa

SEQ ID NO: 11133 - DNA, 20 bp, Artificial Sequence
  Description of Artificial Sequence: Synthetic oligonucleotide
  Target: SOD1; (+) strand; PAM type: NRG; PAM sequence: TGG
taggagaggaaaagctaaat

SEQ ID NO: 11134 - DNA, 20 bp, Artificial Sequence
  Description of Artificial Sequence: Synthetic oligonucleotide
  Target: SOD1; (+) strand; PAM type: NRG; PAM sequence: AAG
gagaggaaaagctaaattgg

SEQ ID NO: 11135 - DNA, 20 bp, Artificial Sequence
  Description of Artificial Sequence: Synthetic oligonucleotide
  Target: SOD1; (+) strand; PAM type: NRG; PAM sequence: TAG
taaattggaagacaaatctg

SEQ ID NO: 11136 - DNA, 20 bp, Artificial Sequence
  Description of Artificial Sequence: Synthetic oligonucleotide
  Target: SOD1; (+) strand; PAM type: NRG; PAM sequence: AAG
acaaatctgtagtgtttcca

SEQ ID NO: 11137 - DNA, 20 bp, Artificial Sequence
  Description of Artificial Sequence: Synthetic oligonucleotide
  Target: SOD1; (+) strand; PAM type: NRG; PAM sequence: TGG
tttccaaagttttaaaatta

SEQ ID NO: 11138 - DNA, 20 bp, Artificial Sequence
  Description of Artificial Sequence: Synthetic oligonucleotide
  Target: SOD1; (+) strand; PAM type: NRG; PAM sequence: CAG
tttaaaattatggtaaacaa

SEQ ID NO: 11139 - DNA, 20 bp, Artificial Sequence
  Description of Artificial Sequence: Synthetic oligonucleotide
  Target: SOD1; (+) strand; PAM type: NRG; PAM sequence: CAG
ggtaaacaacagtatgttca

SEQ ID NO: 11140 - DNA, 20 bp, Artificial Sequence
  Description of Artificial Sequence: Synthetic oligonucleotide
  Target: SOD1; (+) strand; PAM type: NRG; PAM sequence: AAG
aacaacagtatgttcacagt

SEQ ID NO: 11141 - DNA, 20 bp, Artificial Sequence
  Description of Artificial Sequence: Synthetic oligonucleotide
  Target: SOD1; (+) strand; PAM type: NRG; PAM sequence: TGG
aacagtatgttcacagtaag

SEQ ID NO: 11142 - DNA, 20 bp, Artificial Sequence
  Description of Artificial Sequence: Synthetic oligonucleotide
  Target: SOD1; (+) strand; PAM type: NRG; PAM sequence: CAG
aacaaccattctttaaatct

SEQ ID NO: 11143 - DNA, 20 bp, Artificial Sequence
  Description of Artificial Sequence: Synthetic oligonucleotide
  Target: SOD1; (+) strand; PAM type: NRG; PAM sequence: TAG
aaccattctttaaatctcag

SEQ ID NO: 11144 - DNA, 20 bp, Artificial Sequence
  Description of Artificial Sequence: Synthetic oligonucleotide
  Target: SOD1; (+) strand; PAM type: NRG; PAM sequence: GAG
ccattctttaaatctcagta

SEQ ID NO: 11145 - DNA, 20 bp, Artificial Sequence
  Description of Artificial Sequence: Synthetic oligonucleotide
  Target: SOD1; (+) strand; PAM type: NRG; PAM sequence: AAG
ctcagtagagaatttttaaa

SEQ ID NO: 11146 - DNA, 20 bp, Artificial Sequence
  Description of Artificial Sequence: Synthetic oligonucleotide
  Target: SOD1; (+) strand; PAM type: NRG; PAM sequence: CAG
agtagagaatttttaaaaag

SEQ ID NO: 11147 - DNA, 20 bp, Artificial Sequence
  Description of Artificial Sequence: Synthetic oligonucleotide
  Target: SOD1; (+) strand; PAM type: NRG; PAM sequence: TAG
tttaacacatttccctaatg

SEQ ID NO: 11148 - DNA, 20 bp, Artificial Sequence
  Description of Artificial Sequence: Synthetic oligonucleotide
  Target: SOD1; (+) strand; PAM type: NRG; PAM sequence: TGG
aatgtagtttgttgcctatg

SEQ ID NO: 11149 - DNA, 20 bp, Artificial Sequence
  Description of Artificial Sequence: Synthetic oligonucleotide
  Target: SOD1; (+) strand; PAM type: NRG; PAM sequence: TAG
cctatgtggaataactcaat

SEQ ID NO: 11150 - DNA, 20 bp, Artificial Sequence
  Description of Artificial Sequence: Synthetic oligonucleotide
  Target: SOD1; (+) strand; PAM type: NRG; PAM sequence: GAG
tatgtggaataactcaatta

SEQ ID NO: 11151 - DNA, 20 bp, Artificial Sequence
  Description of Artificial Sequence: Synthetic oligonucleotide
  Target: SOD1; (+) strand; PAM type: NRG; PAM sequence: CAG
ttcaaatataattacactac

SEQ ID NO: 11152 - DNA, 20 bp, Artificial Sequence
  Description of Artificial Sequence: Synthetic oligonucleotide
  Target: SOD1; (+) strand; PAM type: NRG; PAM sequence: TAG
ccagtttttacatgtgcata

SEQ ID NO: 11153 - DNA, 20 bp, Artificial Sequence
  Description of Artificial Sequence: Synthetic oligonucleotide
  Target: SOD1; (+) strand; PAM type: NRG; PAM sequence: AGG
cagtttttacatgtgcatat

SEQ ID NO: 11154 - DNA, 20 bp, Artificial Sequence
  Description of Artificial Sequence: Synthetic oligonucleotide
  Target: SOD1; (+) strand; PAM type: NRG; PAM sequence: TGG
ttttacatgtgcatatagga

SEQ ID NO: 11155 - DNA, 20 bp, Artificial Sequence
  Description of Artificial Sequence: Synthetic oligonucleotide
  Target: SOD1; (+) strand; PAM type: NRG; PAM sequence: TGG
atggtcccaatactttaaat

SEQ ID NO: 11156 - DNA, 20 bp, Artificial Sequence
  Description of Artificial Sequence: Synthetic oligonucleotide
  Target: SOD1; (+) strand; PAM type: NRG; PAM sequence: CAG
aatactttaaattggaaata

SEQ ID NO: 11157 - DNA, 20 bp, Artificial Sequence
  Description of Artificial Sequence: Synthetic oligonucleotide
  Target: SOD1; (+) strand; PAM type: NRG; PAM sequence: AGG
atactttaaattggaaatac

SEQ ID NO: 11158 - DNA, 20 bp, Artificial Sequence
  Description of Artificial Sequence: Synthetic oligonucleotide
  Target: SOD1; (+) strand; PAM type: NRG; PAM sequence: AAG
aaattggaaatacaggctgt

SEQ ID NO: 11159 - DNA, 20 bp, Artificial Sequence
  Description of Artificial Sequence: Synthetic oligonucleotide
  Target: SOD1; (+) strand; PAM type: NRG; PAM sequence: AAG
atacaggctgtaagtccttc

SEQ ID NO: 11160 - DNA, 20 bp, Artificial Sequence
  Description of Artificial Sequence: Synthetic oligonucleotide
  Target: SOD1; (+) strand; PAM type: NRG; PAM sequence: TGG
ggctgtaagtccttcaagtc

SEQ ID NO: 11161 - DNA, 20 bp, Artificial Sequence
  Description of Artificial Sequence: Synthetic oligonucleotide
  Target: SOD1; (+) strand; PAM type: NRG; PAM sequence: TGG
agtccttcaagtctggatgt

SEQ ID NO: 11162 - DNA, 20 bp, Artificial Sequence
  Description of Artificial Sequence: Synthetic oligonucleotide
  Target: SOD1; (+) strand; PAM type: NRG; PAM sequence: GGG
gtccttcaagtctggatgtt

SEQ ID NO: 11163 - DNA, 20 bp, Artificial Sequence
  Description of Artificial Sequence: Synthetic oligonucleotide
  Target: SOD1; (+) strand; PAM type: NRG; PAM sequence: CAG
tgggtaatcacgttttcttc

SEQ ID NO: 11164 - DNA, 20 bp, Artificial Sequence
  Description of Artificial Sequence: Synthetic oligonucleotide
  Target: SOD1; (+) strand; PAM type: NRG; PAM sequence: AAG
gtaatcacgttttcttccag

SEQ ID NO: 11165 - DNA, 20 bp, Artificial Sequence
  Description of Artificial Sequence: Synthetic oligonucleotide
  Target: SOD1; (+) strand; PAM type: NRG; PAM sequence: TAG
ttcttccagaagccatttgt

SEQ ID NO: 11166 - DNA, 20 bp, Artificial Sequence
  Description of Artificial Sequence: Synthetic oligonucleotide
  Target: SOD1; (+) strand; PAM type: NRG; PAM sequence: AGG
tcttccagaagccatttgtt

SEQ ID NO: 11167 - DNA, 20 bp, Artificial Sequence
  Description of Artificial Sequence: Synthetic oligonucleotide
  Target: SOD1; (+) strand; PAM type: NRG; PAM sequence: CAG
gttaggactttaaaacttct

SEQ ID NO: 11168 - DNA, 20 bp, Artificial Sequence
  Description of Artificial Sequence: Synthetic oligonucleotide
  Target: SOD1; (+) strand; PAM type: NRG; PAM sequence: TGG
aggactttaaaacttctcag

SEQ ID NO: 11169 - DNA, 20 bp, Artificial Sequence
  Description of Artificial Sequence: Synthetic oligonucleotide
  Target: SOD1; (+) strand; PAM type: NRG; PAM sequence: GGG
ggactttaaaacttctcagt

SEQ ID NO: 11170 - DNA, 20 bp, Artificial Sequence
  Description of Artificial Sequence: Synthetic oligonucleotide
  Target: SOD1; (+) strand; PAM type: NRG; PAM sequence: CAG
tttaaaacttctcagtgggc

SEQ ID NO: 11171 - DNA, 20 bp, Artificial Sequence
  Description of Artificial Sequence: Synthetic oligonucleotide
  Target: SOD1; (+) strand; PAM type: NRG; PAM sequence: AAG
cagtgggccagtgtaaaatt

SEQ ID NO: 11172 - DNA, 20 bp, Artificial Sequence
  Description of Artificial Sequence: Synthetic oligonucleotide
  Target: SOD1; (+) strand; PAM type: NRG; PAM sequence: AGG
agtgggccagtgtaaaatta

SEQ ID NO: 11173 - DNA, 20 bp, Artificial Sequence
  Description of Artificial Sequence: Synthetic oligonucleotide
  Target: SOD1; (+) strand; PAM type: NRG; PAM sequence: AAG
gccagtgtaaaattaaggac

SEQ ID NO: 11174 - DNA, 20 bp, Artificial Sequence
  Description of Artificial Sequence: Synthetic oligonucleotide
  Target: SOD1; (+) strand; PAM type: NRG; PAM sequence: CAG
agttttataatttaaattta

SEQ ID NO: 11175 - DNA, 20 bp, Artificial Sequence
  Description of Artificial Sequence: Synthetic oligonucleotide
  Target: SOD1; (+) strand; PAM type: NRG; PAM sequence: AAG
caattttctctcattttcta

SEQ ID NO: 11176 - DNA, 20 bp, Artificial Sequence
  Description of Artificial Sequence: Synthetic oligonucleotide
  Target: SOD1; (+) strand; PAM type: NRG; PAM sequence: AGG
aattttctctcattttctaa

SEQ ID NO: 11177 - DNA, 20 bp, Artificial Sequence
  Description of Artificial Sequence: Synthetic oligonucleotide
  Target: SOD1; (+) strand; PAM type: NRG; PAM sequence: CAG
tttctctcattttctaaagg

SEQ ID NO: 11178 - DNA, 20 bp, Artificial Sequence
  Description of Artificial Sequence: Synthetic oligonucleotide
  Target: SOD1; (+) strand; PAM type: NRG; PAM sequence: AGG
ttctctcattttctaaaggc

SEQ ID NO: 11179 - DNA, 20 bp, Artificial Sequence
  Description of Artificial Sequence: Synthetic oligonucleotide
  Target: SOD1; (+) strand; PAM type: NRG; PAM sequence: AAG
ttttctaaaggcaggaatat

SEQ ID NO: 11180 - DNA, 20 bp, Artificial Sequence
  Description of Artificial Sequence: Synthetic oligonucleotide
  Target: SOD1; (+) strand; PAM type: NRG; PAM sequence: AGG
tttctaaaggcaggaatata

SEQ ID NO: 11181 - DNA, 20 bp, Artificial Sequence
  Description of Artificial Sequence: Synthetic oligonucleotide
  Target: SOD1; (+) strand; PAM type: NRG; PAM sequence: TAG
ggaatataaggacattgccc

SEQ ID NO: 11182 - DNA, 20 bp, Artificial Sequence
  Description of Artificial Sequence: Synthetic oligonucleotide
  Target: SOD1; (+) strand; PAM type: NRG; PAM sequence: AAG
atattctccccatcaaacca

SEQ ID NO: 11183 - DNA, 20 bp, Artificial Sequence
  Description of Artificial Sequence: Synthetic oligonucleotide
  Target: SOD1; (+) strand; PAM type: NRG; PAM sequence: AGG
tattctccccatcaaaccaa

SEQ ID NO: 11184 - DNA, 20 bp, Artificial Sequence
  Description of Artificial Sequence: Synthetic oligonucleotide
  Target: SOD1; (+) strand; PAM type: NRG; PAM sequence: GAG
aaaccaaaggtcttgctgct

SEQ ID NO: 11185 - DNA, 20 bp, Artificial Sequence
  Description of Artificial Sequence: Synthetic oligonucleotide
  Target: SOD1; (+) strand; PAM type: NRG; PAM sequence: CAG
gctgagtattatttaaaaac

SEQ ID NO: 11186 - DNA, 20 bp, Artificial Sequence
  Description of Artificial Sequence: Synthetic oligonucleotide
  Target: SOD1; (+) strand; PAM type: NRG; PAM sequence: GAG
tgagtattatttaaaaacca

SEQ ID NO: 11187 - DNA, 20 bp, Artificial Sequence
  Description of Artificial Sequence: Synthetic oligonucleotide
  Target: SOD1; (+) strand; PAM type: NRG; PAM sequence: AAG
atttaaaaaccagagtaata

SEQ ID NO: 11188 - DNA, 20 bp, Artificial Sequence
  Description of Artificial Sequence: Synthetic oligonucleotide
  Target: SOD1; (+) strand; PAM type: NRG; PAM sequence: CAG
taaaaaccagagtaataaag

SEQ ID NO: 11189 - DNA, 20 bp, Artificial Sequence
  Description of Artificial Sequence: Synthetic oligonucleotide
  Target: SOD1; (+) strand; PAM type: NRG; PAM sequence: GAG
gtaataaagcagcttcgcct

SEQ ID NO: 11190 - DNA, 20 bp, Artificial Sequence
  Description of Artificial Sequence: Synthetic oligonucleotide
  Target: SOD1; (+) strand; PAM type: NRG; PAM sequence: AGG
taataaagcagcttcgcctg

SEQ ID NO: 11191 - DNA, 20 bp, Artificial Sequence
  Description of Artificial Sequence: Synthetic oligonucleotide
  Target: SOD1; (+) strand; PAM type: NRG; PAM sequence: AAG
agcagcttcgcctgaggatg

SEQ ID NO: 11192 - DNA, 20 bp, Artificial Sequence
  Description of Artificial Sequence: Synthetic oligonucleotide
  Target: SOD1; (+) strand; PAM type: NRG; PAM sequence: AGG
gcagcttcgcctgaggatga

SEQ ID NO: 11193 - DNA, 20 bp, Artificial Sequence
  Description of Artificial Sequence: Synthetic oligonucleotide
  Target: SOD1; (+) strand; PAM type: NRG; PAM sequence: AAG
ttcgcctgaggatgaaggca

SEQ ID NO: 11194 - DNA, 20 bp, Artificial Sequence
  Description of Artificial Sequence: Synthetic oligonucleotide
  Target: SOD1; (+) strand; PAM type: NRG; PAM sequence: AAG
tgaggatgaaggcaaagaca

SEQ ID NO: 11195 - DNA, 20 bp, Artificial Sequence
  Description of Artificial Sequence: Synthetic oligonucleotide
  Target: SOD1; (+) strand; PAM type: NRG; PAM sequence: CAG
caaagacaaagttaactgct

SEQ ID NO: 11196 - DNA, 20 bp, Artificial Sequence
  Description of Artificial Sequence: Synthetic oligonucleotide
  Target: SOD1; (+) strand; PAM type: NRG; PAM sequence: CAG
actgctcagcatactgaaac

SEQ ID NO: 11197 - DNA, 20 bp, Artificial Sequence
  Description of Artificial Sequence: Synthetic oligonucleotide
  Target: SOD1; (+) strand; PAM type: NRG; PAM sequence: AGG
ctgctcagcatactgaaacc

SEQ ID NO: 11198 - DNA, 20 bp, Artificial Sequence
  Description of Artificial Sequence: Synthetic oligonucleotide
  Target: SOD1; (+) strand; PAM type: NRG; PAM sequence: GAG
gctcagcatactgaaaccag

SEQ ID NO: 11199 - DNA, 20 bp, Artificial Sequence
  Description of Artificial Sequence: Synthetic oligonucleotide
  Target: SOD1; (+) strand; PAM type: NRG; PAM sequence: AAG
ctgaaaccaggagtttgaaa

SEQ ID NO: 11200 - DNA, 20 bp, Artificial Sequence
  Description of Artificial Sequence: Synthetic oligonucleotide
  Target: SOD1; (+) strand; PAM type: NRG; PAM sequence: AAG
aagtaattcaaaacaacttc

SEQ ID NO: 11201 - DNA, 20 bp, Artificial Sequence
  Description of Artificial Sequence: Synthetic oligonucleotide
  Target: SOD1; (+) strand; PAM type: NRG; PAM sequence: AGG
agtaattcaaaacaacttca

SEQ ID NO: 11202 - DNA, 20 bp, Artificial Sequence
  Description of Artificial Sequence: Synthetic oligonucleotide
  Target: SOD1; (+) strand; PAM type: NRG; PAM sequence: TGG
acttcaaggccataaatact

SEQ ID NO: 11203 - DNA, 20 bp, Artificial Sequence
  Description of Artificial Sequence: Synthetic oligonucleotide
  Target: SOD1; (+) strand; PAM type: NRG; PAM sequence: TAG
caaggccataaatacttgga

SEQ ID NO: 11204 - DNA, 20 bp, Artificial Sequence
  Description of Artificial Sequence: Synthetic oligonucleotide
  Target: SOD1; (+) strand; PAM type: NRG; PAM sequence: CAG
atacttggatagtgtgacat

SEQ ID NO: 11205 - DNA, 20 bp, Artificial Sequence
  Description of Artificial Sequence: Synthetic oligonucleotide
  Target: SOD1; (+) strand; PAM type: NRG; PAM sequence: AGG
tacttggatagtgtgacatc

SEQ ID NO: 11206 - DNA, 20 bp, Artificial Sequence
  Description of Artificial Sequence: Synthetic oligonucleotide
  Target: SOD1; (+) strand; PAM type: NRG; PAM sequence: TGG
gatagtgtgacatcaggtct

SEQ ID NO: 11207 - DNA, 20 bp, Artificial Sequence
  Description of Artificial Sequence: Synthetic oligonucleotide
  Target: SOD1; (+) strand; PAM type: NRG; PAM sequence: TGG
gtgacatcaggtcttggcac

SEQ ID NO: 11208 - DNA, 20 bp, Artificial Sequence
  Description of Artificial Sequence: Synthetic oligonucleotide
  Target: SOD1; (+) strand; PAM type: NRG; PAM sequence: CAG
cactggatttcctgcaattt

SEQ ID NO: 11209 - DNA, 20 bp, Artificial Sequence
  Description of Artificial Sequence: Synthetic oligonucleotide
  Target: SOD1; (+) strand; PAM type: NRG; PAM sequence: AAG
atttcctgcaatttcagatg

SEQ ID NO: 11210 - DNA, 20 bp, Artificial Sequence
  Description of Artificial Sequence: Synthetic oligonucleotide
  Target: SOD1; (+) strand; PAM type: NRG; PAM sequence: AGG
tttcctgcaatttcagatga

SEQ ID NO: 11211 - DNA, 20 bp, Artificial Sequence
  Description of Artificial Sequence: Synthetic oligonucleotide
  Target: SOD1; (+) strand; PAM type: NRG; PAM sequence: TGG
tttcagatgaaggcttgact

SEQ ID NO: 11212 - DNA, 20 bp, Artificial Sequence
  Description of Artificial Sequence: Synthetic oligonucleotide
  Target: SOD1; (+) strand; PAM type: NRG; PAM sequence: TAG
atgaaggcttgacttggctt

SEQ ID NO: 11213 - DNA, 20 bp, Artificial Sequence
  Description of Artificial Sequence: Synthetic oligonucleotide
  Target: SOD1; (+) strand; PAM type: NRG; PAM sequence: TGG
tgttttcatgtgataattct

SEQ ID NO: 11214 - DNA, 20 bp, Artificial Sequence
  Description of Artificial Sequence: Synthetic oligonucleotide
  Target: SOD1; (+) strand; PAM type: NRG; PAM sequence: AAG
ctatttaacccaccaacttt

SEQ ID NO: 11215 - DNA, 20 bp, Artificial Sequence
  Description of Artificial Sequence: Synthetic oligonucleotide
  Target: SOD1; (+) strand; PAM type: NRG; PAM sequence: AAG
aacccaccaactttaagcaa

SEQ ID NO: 11216 - DNA, 20 bp, Artificial Sequence
  Description of Artificial Sequence: Synthetic oligonucleotide
  Target: SOD1; (+) strand; PAM type: NRG; PAM sequence: AAG
caccaactttaagcaaaaga

SEQ ID NO: 11217 - DNA, 20 bp, Artificial Sequence
  Description of Artificial Sequence: Synthetic oligonucleotide
  Target: SOD1; (+) strand; PAM type: NRG; PAM sequence: TGG
caaaagaaagaacgtatatg

SEQ ID NO: 11218 - DNA, 20 bp, Artificial Sequence
  Description of Artificial Sequence: Synthetic oligonucleotide
  Target: SOD1; (+) strand; PAM type: NRG; PAM sequence: GGG
aaaagaaagaacgtatatgt

SEQ ID NO: 11219 - DNA, 20 bp, Artificial Sequence
  Description of Artificial Sequence: Synthetic oligonucleotide
  Target: SOD1; (+) strand; PAM type: NRG; PAM sequence: GGG
aaagaaagaacgtatatgtg

SEQ ID NO: 11220 - DNA, 20 bp, Artificial Sequence
  Description of Artificial Sequence: Synthetic oligonucleotide
  Target: SOD1; (+) strand; PAM type: NRG; PAM sequence: GGG
aagaaagaacgtatatgtgg

SEQ ID NO: 11221 - DNA, 20 bp, Artificial Sequence
  Description of Artificial Sequence: Synthetic oligonucleotide
  Target: SOD1; (+) strand; PAM type: NRG; PAM sequence: AAG
agaacgtatatgtgggggaa

SEQ ID NO: 11222 - DNA, 20 bp, Artificial Sequence
  Description of Artificial Sequence: Synthetic oligonucleotide
  Target: SOD1; (+) strand; PAM type: NRG; PAM sequence: CAG
gttcgtttacctctgccccg

SEQ ID NO: 11223 - DNA, 20 bp, Artificial Sequence
  Description of Artificial Sequence: Synthetic oligonucleotide
  Target: SOD1; (+) strand; PAM type: NRG; PAM sequence: AGG
ttcgtttacctctgccccgc

SEQ ID NO: 11224 - DNA, 20 bp, Artificial Sequence
  Description of Artificial Sequence: Synthetic oligonucleotide
  Target: SOD1; (+) strand; PAM type: NRG; PAM sequence: GGG
tcgtttacctctgccccgca

SEQ ID NO: 11225 - DNA, 20 bp, Artificial Sequence
  Description of Artificial Sequence: Synthetic oligonucleotide
  Target: SOD1; (+) strand; PAM type: NRG; PAM sequence: GGG
cgtttacctctgccccgcag

SEQ ID NO: 11226 - DNA, 20 bp, Artificial Sequence
  Description of Artificial Sequence: Synthetic oligonucleotide
  Target: SOD1; (+) strand; PAM type: NRG; PAM sequence: TGG
ccgcaggggaattaaaacgc

SEQ ID NO: 11227 - DNA, 20 bp, Artificial Sequence
  Description of Artificial Sequence: Synthetic oligonucleotide
  Target: SOD1; (+) strand; PAM type: NRG; PAM sequence: AAG
ggggaattaaaacgctggtg

SEQ ID NO: 11228 - DNA, 20 bp, Artificial Sequence
  Description of Artificial Sequence: Synthetic oligonucleotide
  Target: SOD1; (+) strand; PAM type: NRG; PAM sequence: AAG
aattaaaacgctggtgaaga

SEQ ID NO: 11229 - DNA, 20 bp, Artificial Sequence
  Description of Artificial Sequence: Synthetic oligonucleotide
  Target: SOD1; (+) strand; PAM type: NRG; PAM sequence: AGG
attaaaacgctggtgaagaa

SEQ ID NO: 11230 - DNA, 20 bp, Artificial Sequence
  Description of Artificial Sequence: Synthetic oligonucleotide
  Target: SOD1; (+) strand; PAM type: NRG; PAM sequence: CAG
acgctggtgaagaaaggcaa

SEQ ID NO: 11231 - DNA, 20 bp, Artificial Sequence
  Description of Artificial Sequence: Synthetic oligonucleotide
  Target: SOD1; (+) strand; PAM type: NRG; PAM sequence: AGG
cgctggtgaagaaaggcaac

SEQ ID NO: 11232 - DNA, 20 bp, Artificial Sequence
  Description of Artificial Sequence: Synthetic oligonucleotide
  Target: SOD1; (+) strand; PAM type: NRG; PAM sequence: AAG
ggtgaagaaaggcaacaggc

SEQ ID NO: 11233 - DNA, 20 bp, Artificial Sequence
  Description of Artificial Sequence: Synthetic oligonucleotide
  Target: SOD1; (+) strand; PAM type: NRG; PAM sequence: AGG
gtgaagaaaggcaacaggca

SEQ ID NO: 11234 - DNA, 20 bp, Artificial Sequence
  Description of Artificial Sequence: Synthetic oligonucleotide
  Target: SOD1; (+) strand; PAM type: NRG; PAM sequence: AAG
gcaacaggcaaggcttatat

SEQ ID NO: 11235 - DNA, 20 bp, Artificial Sequence
  Description of Artificial Sequence: Synthetic oligonucleotide
  Target: SOD1; (+) strand; PAM type: NRG; PAM sequence: AGG
caacaggcaaggcttatata

SEQ ID NO: 11236 - DNA, 20 bp, Artificial Sequence
  Description of Artificial Sequence: Synthetic oligonucleotide
  Target: SOD1; (+) strand; PAM type: NRG; PAM sequence: CAG
gcaaggcttatataaggaaa

SEQ ID NO: 11237 - DNA, 20 bp, Artificial Sequence
  Description of Artificial Sequence: Synthetic oligonucleotide
  Target: SOD1; (+) strand; PAM type: NRG; PAM sequence: TAG
aggcttatataaggaaacag

SEQ ID NO: 11238 - DNA, 20 bp, Artificial Sequence
  Description of Artificial Sequence: Synthetic oligonucleotide
  Target: SOD1; (+) strand; PAM type: NRG; PAM sequence: TAG
cttatataaggaaacagtag

SEQ ID NO: 11239 - DNA, 20 bp, Artificial Sequence
  Description of Artificial Sequence: Synthetic oligonucleotide
  Target: SOD1; (+) strand; PAM type: NRG; PAM sequence: AGG
ttatataaggaaacagtagt

SEQ ID NO: 11240 - DNA, 20 bp, Artificial Sequence
  Description of Artificial Sequence: Synthetic oligonucleotide
  Target: SOD1; (+) strand; PAM type: NRG; PAM sequence: AAG
aacagtagtaggctgcactg

SEQ ID NO: 11241 - DNA, 20 bp, Artificial Sequence
  Description of Artificial Sequence: Synthetic oligonucleotide
  Target: SOD1; (+) strand; PAM type: NRG; PAM sequence: AAG
aagtcctcaaacacaacaaa

SEQ ID NO: 11242 - DNA, 20 bp, Artificial Sequence
  Description of Artificial Sequence: Synthetic oligonucleotide
  Target: SOD1; (+) strand; PAM type: NRG; PAM sequence: TAG
caaacacaacaaaaagctct

SEQ ID NO: 11243 - DNA, 20 bp, Artificial Sequence
  Description of Artificial Sequence: Synthetic oligonucleotide
  Target: SOD1; (+) strand; PAM type: NRG; PAM sequence: AGG
aaacacaacaaaaagctctt

SEQ ID NO: 11244 - DNA, 20 bp, Artificial Sequence
  Description of Artificial Sequence: Synthetic oligonucleotide
  Target: SOD1; (+) strand; PAM type: NRG; PAM sequence: TGG
tacccttttgaaaaattcaa

SEQ ID NO: 11245 - DNA, 20 bp, Artificial Sequence
  Description of Artificial Sequence: Synthetic oligonucleotide
  Target: SOD1; (+) strand; PAM type: NRG; PAM sequence: GGG
acccttttgaaaaattcaat

SEQ ID NO: 11246 - DNA, 20 bp, Artificial Sequence
  Description of Artificial Sequence: Synthetic oligonucleotide
  Target: SOD1; (+) strand; PAM type: NRG; PAM sequence: TGG
ttttgaaaaattcaatggga

SEQ ID NO: 11247 - DNA, 20 bp, Artificial Sequence
  Description of Artificial Sequence: Synthetic oligonucleotide
  Target: SOD1; (+) strand; PAM type: NRG; PAM sequence: TGG
gaaaaattcaatgggatggt

SEQ ID NO: 11248 - DNA, 20 bp, Artificial Sequence
  Description of Artificial Sequence: Synthetic oligonucleotide
  Target: SOD1; (+) strand; PAM type: NRG; PAM sequence: CAG
gttggaaaaaaaaaaaacca

SEQ ID NO: 11249 - DNA, 20 bp, Artificial Sequence
  Description of Artificial Sequence: Synthetic oligonucleotide
  Target: SOD1; (+) strand; PAM type: NRG; PAM sequence: CAG
caaccttctaacgtaatacc

SEQ ID NO: 11250 - DNA, 20 bp, Artificial Sequence
  Description of Artificial Sequence: Synthetic oligonucleotide
  Target: SOD1; (+) strand; PAM type: NRG; PAM sequence: AGG
aaccttctaacgtaataccc

SEQ ID NO: 11251 - DNA, 20 bp, Artificial Sequence
  Description of Artificial Sequence: Synthetic oligonucleotide
  Target: SOD1; (+) strand; PAM type: NRG; PAM sequence: CAG
cttctaacgtaatacccagg

SEQ ID NO: 11252 - DNA, 20 bp, Artificial Sequence
  Description of Artificial Sequence: Synthetic oligonucleotide
  Target: SOD1; (+) strand; PAM type: NRG; PAM sequence: TAG
ccaggcagtccgataattta

SEQ ID NO: 11253 - DNA, 20 bp, Artificial Sequence
  Description of Artificial Sequence: Synthetic oligonucleotide
  Target: SOD1; (+) strand; PAM type: NRG; PAM sequence: TGG
tatagtacaacgtgtaacac

SEQ ID NO: 11254 - DNA, 20 bp, Artificial Sequence
  Description of Artificial Sequence: Synthetic oligonucleotide
  Target: SOD1; (+) strand; PAM type: NRG; PAM sequence: GGG
atagtacaacgtgtaacact

SEQ ID NO: 11255 - DNA, 20 bp, Artificial Sequence
  Description of Artificial Sequence: Synthetic oligonucleotide
  Target: SOD1; (+) strand; PAM type: NRG; PAM sequence: CAG
ctgggatccaacttttcacc

SEQ ID NO: 11256 - DNA, 20 bp, Artificial Sequence
  Description of Artificial Sequence: Synthetic oligonucleotide
  Target: SOD1; (+) strand; PAM type: NRG; PAM sequence: TAG
agcaaaatctccttacaaat

SEQ ID NO: 11257 - DNA, 20 bp, Artificial Sequence
  Description of Artificial Sequence: Synthetic oligonucleotide
  Target: SOD1; (+) strand; PAM type: NRG; PAM sequence: AGG
gcaaaatctccttacaaatt

SEQ ID NO: 11258 - DNA, 20 bp, Artificial Sequence
  Description of Artificial Sequence: Synthetic oligonucleotide
  Target: SOD1; (+) strand; PAM type: NRG; PAM sequence: GGG
caaaatctccttacaaatta

SEQ ID NO: 11259 - DNA, 20 bp, Artificial Sequence
  Description of Artificial Sequence: Synthetic oligonucleotide
  Target: SOD1; (+) strand; PAM type: NRG; PAM sequence: AAG
ttagggcaacatataccaca

SEQ ID NO: 11260 - DNA, 20 bp, Artificial Sequence
  Description of Artificial Sequence: Synthetic oligonucleotide
  Target: SOD1; (+) strand; PAM type: NRG; PAM sequence: TGG
aacatataccacaaagccaa

SEQ ID NO: 11261 - DNA, 20 bp, Artificial Sequence
  Description of Artificial Sequence: Synthetic oligonucleotide
  Target: SOD1; (+) strand; PAM type: NRG; PAM sequence: AAG
acaaagccaatggaaaaaaa

SEQ ID NO: 11262 - DNA, 20 bp, Artificial Sequence
  Description of Artificial Sequence: Synthetic oligonucleotide
  Target: SOD1; (+) strand; PAM type: NRG; PAM sequence: CAG
cctcgattgaattgcaaaca

SEQ ID NO: 11263 - DNA, 20 bp, Artificial Sequence
  Description of Artificial Sequence: Synthetic oligonucleotide
  Target: SOD1; (+) strand; PAM type: NRG; PAM sequence: GAG
ctaacctttaccttatgact

SEQ ID NO: 11264 - DNA, 20 bp, Artificial Sequence
  Description of Artificial Sequence: Synthetic oligonucleotide
  Target: SOD1; (+) strand; PAM type: NRG; PAM sequence: AAG
gactgagcactaaaaatcaa

SEQ ID NO: 11265 - DNA, 20 bp, Artificial Sequence
  Description of Artificial Sequence: Synthetic oligonucleotide
  Target: SOD1; (+) strand; PAM type: NRG; PAM sequence: AAG
atcaaaagtattacatatga

SEQ ID NO: 11266 - DNA, 20 bp, Artificial Sequence
  Description of Artificial Sequence: Synthetic oligonucleotide
  Target: SOD1; (+) strand; PAM type: NRG; PAM sequence: GAG
aaagtattacatatgaaagt

SEQ ID NO: 11267 - DNA, 20 bp, Artificial Sequence
  Description of Artificial Sequence: Synthetic oligonucleotide
  Target: SOD1; (+) strand; PAM type: NRG; PAM sequence: AAG
aatgtctattttcatcaaat

SEQ ID NO: 11268 - DNA, 20 bp, Artificial Sequence
  Description of Artificial Sequence: Synthetic oligonucleotide
  Target: SOD1; (+) strand; PAM type: NRG; PAM sequence: TAG
ttcatcaaataagtctaatt

SEQ ID NO: 11269 - DNA, 20 bp, Artificial Sequence
  Description of Artificial Sequence: Synthetic oligonucleotide
  Target: SOD1; (+) strand; PAM type: NRG; PAM sequence: CAG
gtctaatttagactccaata

SEQ ID NO: 11270 - DNA, 20 bp, Artificial Sequence
  Description of Artificial Sequence: Synthetic oligonucleotide
  Target: SOD1; (+) strand; PAM type: NRG; PAM sequence: CAG
agactccaatacagtattaa

SEQ ID NO: 11271 - DNA, 20 bp, Artificial Sequence
  Description of Artificial Sequence: Synthetic oligonucleotide
  Target: SOD1; (+) strand; PAM type: NRG; PAM sequence: CGG
attaacagctcaaactttga

SEQ ID NO: 11272 - DNA, 20 bp, Artificial Sequence
  Description of Artificial Sequence: Synthetic oligonucleotide
  Target: SOD1; (+) strand; PAM type: NRG; PAM sequence: CAG
aatccttttccaccttaatg

SEQ ID NO: 11273 - DNA, 20 bp, Artificial Sequence
  Description of Artificial Sequence: Synthetic oligonucleotide
  Target: SOD1; (+) strand; PAM type: NRG; PAM sequence: TAG
ttttccaccttaatgcagtg

SEQ ID NO: 11274 - DNA, 20 bp, Artificial Sequence
  Description of Artificial Sequence: Synthetic oligonucleotide
  Target: SOD1; (+) strand; PAM type: NRG; PAM sequence: AGG
tttccaccttaatgcagtgt

SEQ ID NO: 11275 - DNA, 20 bp, Artificial Sequence
  Description of Artificial Sequence: Synthetic oligonucleotide
  Target: SOD1; (+) strand; PAM type: NRG; PAM sequence: AAG
ccaccttaatgcagtgtagg

SEQ ID NO: 11276 - DNA, 20 bp, Artificial Sequence
  Description of Artificial Sequence: Synthetic oligonucleotide
  Target: SOD1; (+) strand; PAM type: NRG; PAM sequence: TAG
ttaatgcagtgtaggaagaa

SEQ ID NO: 11277 - DNA, 20 bp, Artificial Sequence
  Description of Artificial Sequence: Synthetic oligonucleotide
  Target: SOD1; (+) strand; PAM type: NRG; PAM sequence: AAG
aggaagaatagcacacatta

SEQ ID NO: 11278 - DNA, 20 bp, Artificial Sequence
  Description of Artificial Sequence: Synthetic oligonucleotide
  Target: SOD1; (+) strand; PAM type: NRG; PAM sequence: TAG
attaaagtttgttacgaaaa

SEQ ID NO: 11279 - DNA, 20 bp, Artificial Sequence
  Description of Artificial Sequence: Synthetic oligonucleotide
  Target: SOD1; (+) strand; PAM type: NRG; PAM sequence: GAG
taaagtttgttacgaaaata

SEQ ID NO: 11280 - DNA, 20 bp, Artificial Sequence
  Description of Artificial Sequence: Synthetic oligonucleotide
  Target: SOD1; (+) strand; PAM type: NRG; PAM sequence: GAG
aaaaacatccctattgtttt

SEQ ID NO: 11281 - DNA, 20 bp, Artificial Sequence
  Description of Artificial Sequence: Synthetic oligonucleotide
  Target: SOD1; (+) strand; PAM type: NRG; PAM sequence: AGG
aaaacatccctattgttttg

SEQ ID NO: 11282 - DNA, 20 bp, Artificial Sequence
  Description of Artificial Sequence: Synthetic oligonucleotide
  Target: SOD1; (+) strand; PAM type: NRG; PAM sequence: GAG
aacatccctattgttttgag

SEQ ID NO: 11283 - DNA, 20 bp, Artificial Sequence
  Description of Artificial Sequence: Synthetic oligonucleotide
  Target: SOD1; (+) strand; PAM type: NRG; PAM sequence: TAG
attaaaaaaaaaaaaaaaaa

SEQ ID NO: 11284 - DNA, 20 bp, Artificial Sequence
  Description of Artificial Sequence: Synthetic oligonucleotide
  Target: SOD1; (+) strand; PAM type: NRG; PAM sequence: GAG
taaaaaaaaaaaaaaaaata

SEQ ID NO: 11285 - DNA, 20 bp, Artificial Sequence
  Description of Artificial Sequence: Synthetic oligonucleotide
  Target: SOD1; (+) strand; PAM type: NRG; PAM sequence: GAG
aaaaaaaaaaaaaaaataga

SEQ ID NO: 11286 - DNA, 20 bp, Artificial Sequence
  Description of Artificial Sequence: Synthetic oligonucleotide
  Target: SOD1; (+) strand; PAM type: NRG; PAM sequence: AAG
tacgatttgtaaacttttta

SEQ ID NO: 11287 - DNA, 20 bp, Artificial Sequence
  Description of Artificial Sequence: Synthetic oligonucleotide
  Target: SOD1; (+) strand; PAM type: NRG; PAM sequence: AAG
ttaaagtcaaaacttttaaa

SEQ ID NO: 11288 - DNA, 20 bp, Artificial Sequence
  Description of Artificial Sequence: Synthetic oligonucleotide
  Target: SOD1; (+) strand; PAM type: NRG; PAM sequence: CAG
tcaaaacttttaaaaagtta

SEQ ID NO: 11289 - DNA, 20 bp, Artificial Sequence
  Description of Artificial Sequence: Synthetic oligonucleotide
  Target: SOD1; (+) strand; PAM type: NRG; PAM sequence: AAG
ttttaaaaagttacagcaaa

SEQ ID NO: 11290 - DNA, 20 bp, Artificial Sequence
  Description of Artificial Sequence: Synthetic oligonucleotide
  Target: SOD1; (+) strand; PAM type: NRG; PAM sequence: AGG
tttaaaaagttacagcaaaa

SEQ ID NO: 11291 - DNA, 20 bp, Artificial Sequence
  Description of Artificial Sequence: Synthetic oligonucleotide
  Target: SOD1; (+) strand; PAM type: NRG; PAM sequence: GGG
ttaaaaagttacagcaaaaa

SEQ ID NO: 11292 - DNA, 20 bp, Artificial Sequence
  Description of Artificial Sequence: Synthetic oligonucleotide
  Target: SOD1; (+) strand; PAM type: NRG; PAM sequence: CAG
gtaatatttattcatatttt

SEQ ID NO: 11293 - DNA, 20 bp, Artificial Sequence
  Description of Artificial Sequence: Synthetic oligonucleotide
  Target: SOD1; (+) strand; PAM type: NRG; PAM sequence: TGG
cagtattttttgttattttg

SEQ ID NO: 11294 - DNA, 20 bp, Artificial Sequence
  Description of Artificial Sequence: Synthetic oligonucleotide
  Target: SOD1; (+) strand; PAM type: NRG; PAM sequence: TAG
attttgtggctatttttaaa

SEQ ID NO: 11295 - DNA, 20 bp, Artificial Sequence
  Description of Artificial Sequence: Synthetic oligonucleotide
  Target: SOD1; (+) strand; PAM type: NRG; PAM sequence: AAG
ttgtggctatttttaaatag

SEQ ID NO: 11296 - DNA, 20 bp, Artificial Sequence
  Description of Artificial Sequence: Synthetic oligonucleotide
  Target: SOD1; (+) strand; PAM type: NRG; PAM sequence: AGG
tgtggctatttttaaataga

SEQ ID NO: 11297 - DNA, 20 bp, Artificial Sequence
  Description of Artificial Sequence: Synthetic oligonucleotide
  Target: SOD1; (+) strand; PAM type: NRG; PAM sequence: GGG
gtggctatttttaaatagaa

SEQ ID NO: 11298 - DNA, 20 bp, Artificial Sequence
  Description of Artificial Sequence: Synthetic oligonucleotide
  Target: SOD1; (+) strand; PAM type: NRG; PAM sequence: AAG
gctatttttaaatagaaggg

SEQ ID NO: 11299 - DNA, 20 bp, Artificial Sequence
  Description of Artificial Sequence: Synthetic oligonucleotide
  Target: SOD1; (+) strand; PAM type: NRG; PAM sequence: CAG
ggaagcaatcaaattgctta

SEQ ID NO: 11300 - DNA, 20 bp, Artificial Sequence
  Description of Artificial Sequence: Synthetic oligonucleotide
  Target: SOD1; (+) strand; PAM type: NRG; PAM sequence: CAG
aattgcttacagttccccac

SEQ ID NO: 11301 - DNA, 20 bp, Artificial Sequence
  Description of Artificial Sequence: Synthetic oligonucleotide
  Target: SOD1; (+) strand; PAM type: NRG; PAM sequence: TGG
gcttacagttccccaccagc

SEQ ID NO: 11302 - DNA, 20 bp, Artificial Sequence
  Description of Artificial Sequence: Synthetic oligonucleotide
  Target: SOD1; (+) strand; PAM type: NRG; PAM sequence: CGG
cagttccccaccagctggcg

SEQ ID NO: 11303 - DNA, 20 bp, Artificial Sequence
  Description of Artificial Sequence: Synthetic oligonucleotide
  Target: SOD1; (+) strand; PAM type: NRG; PAM sequence: GGG
agttccccaccagctggcgc

SEQ ID NO: 11304 - DNA, 20 bp, Artificial Sequence
  Description of Artificial Sequence: Synthetic oligonucleotide
  Target: SOD1; (+) strand; PAM type: NRG; PAM sequence: GGG
gttccccaccagctggcgcg

SEQ ID NO: 11305 - DNA, 20 bp, Artificial Sequence
  Description of Artificial Sequence: Synthetic oligonucleotide
  Target: SOD1; (+) strand; PAM type: NRG; PAM sequence: CAG
caccagctggcgcggggctg

SEQ ID NO: 11306 - DNA, 20 bp, Artificial Sequence
  Description of Artificial Sequence: Synthetic oligonucleotide
  Target: SOD1; (+) strand; PAM type: NRG; PAM sequence: CAG
gctggcgcggggctgcagta

SEQ ID NO: 11307 - DNA, 20 bp, Artificial Sequence
  Description of Artificial Sequence: Synthetic oligonucleotide
  Target: SOD1; (+) strand; PAM type: NRG; PAM sequence: CGG
ggcgcggggctgcagtacag

SEQ ID NO: 11308 - DNA, 20 bp, Artificial Sequence
  Description of Artificial Sequence: Synthetic oligonucleotide
  Target: SOD1; (+) strand; PAM type: NRG; PAM sequence: GGG
gcgcggggctgcagtacagc

SEQ ID NO: 11309 - DNA, 20 bp, Artificial Sequence
  Description of Artificial Sequence: Synthetic oligonucleotide
  Target: SOD1; (+) strand; PAM type: NRG; PAM sequence: GAG
gcggggctgcagtacagcgg

SEQ ID NO: 11310 - DNA, 20 bp, Artificial Sequence
  Description of Artificial Sequence: Synthetic oligonucleotide
  Target: SOD1; (+) strand; PAM type: NRG; PAM sequence: CGG
gggctgcagtacagcgggag

SEQ ID NO: 11311 - DNA, 20 bp, Artificial Sequence
  Description of Artificial Sequence: Synthetic oligonucleotide
  Target: SOD1; (+) strand; PAM type: NRG; PAM sequence: CAG
cagcgggagcggatataata

SEQ ID NO: 11312 - DNA, 20 bp, Artificial Sequence
  Description of Artificial Sequence: Synthetic oligonucleotide
  Target: SOD1; (+) strand; PAM type: NRG; PAM sequence: AAG
atacagcatctgtacacctc

SEQ ID NO: 11313 - DNA, 20 bp, Artificial Sequence
  Description of Artificial Sequence: Synthetic oligonucleotide
  Target: SOD1; (+) strand; PAM type: NRG; PAM sequence: CAG
acacctcaagctctacactc

SEQ ID NO: 11314 - DNA, 20 bp, Artificial Sequence
  Description of Artificial Sequence: Synthetic oligonucleotide
  Target: SOD1; (+) strand; PAM type: NRG; PAM sequence: AGG
cacctcaagctctacactcc

SEQ ID NO: 11315 - DNA, 20 bp, Artificial Sequence
  Description of Artificial Sequence: Synthetic oligonucleotide
  Target: SOD1; (+) strand; PAM type: NRG; PAM sequence: AAG
ctcaagctctacactccagg

SEQ ID NO: 11316 - DNA, 20 bp, Artificial Sequence
  Description of Artificial Sequence: Synthetic oligonucleotide
  Target: SOD1; (+) strand; PAM type: NRG; PAM sequence: CAG
tgtcacattttcacaaattc

SEQ ID NO: 11317 - DNA, 20 bp, Artificial Sequence
  Description of Artificial Sequence: Synthetic oligonucleotide
  Target: SOD1; (+) strand; PAM type: NRG; PAM sequence: GAG
cacaaattccagtctctaac

SEQ ID NO: 11318 - DNA, 20 bp, Artificial Sequence
  Description of Artificial Sequence: Synthetic oligonucleotide
  Target: SOD1; (+) strand; PAM type: NRG; PAM sequence: AGG
acaaattccagtctctaacg

SEQ ID NO: 11319 - DNA, 20 bp, Artificial Sequence
  Description of Artificial Sequence: Synthetic oligonucleotide
  Target: SOD1; (+) strand; PAM type: NRG; PAM sequence: GAG
aaattccagtctctaacgag

SEQ ID NO: 11320 - DNA, 20 bp, Artificial Sequence
  Description of Artificial Sequence: Synthetic oligonucleotide
  Target: SOD1; (+) strand; PAM type: NRG; PAM sequence: GAG
aacgaggagcctctgctgct

SEQ ID NO: 11321 - DNA, 20 bp, Artificial Sequence
  Description of Artificial Sequence: Synthetic oligonucleotide
  Target: SOD1; (+) strand; PAM type: NRG; PAM sequence: CAG
aggagcctctgctgctgagc

SEQ ID NO: 11322 - DNA, 20 bp, Artificial Sequence
  Description of Artificial Sequence: Synthetic oligonucleotide
  Target: SOD1; (+) strand; PAM type: NRG; PAM sequence: CGG
tgctgagccagaatcctttt

SEQ ID NO: 11323 - DNA, 20 bp, Artificial Sequence
  Description of Artificial Sequence: Synthetic oligonucleotide
  Target: SOD1; (+) strand; PAM type: NRG; PAM sequence: GGG
gctgagccagaatccttttc

SEQ ID NO: 11324 - DNA, 20 bp, Artificial Sequence
  Description of Artificial Sequence: Synthetic oligonucleotide
  Target: SOD1; (+) strand; PAM type: NRG; PAM sequence: CGG
agaatccttttcgggttcaa

SEQ ID NO: 11325 - DNA, 20 bp, Artificial Sequence
  Description of Artificial Sequence: Synthetic oligonucleotide
  Target: SOD1; (+) strand; PAM type: NRG; PAM sequence: GAG
ccttttcgggttcaacggat

SEQ ID NO: 11326 - DNA, 20 bp, Artificial Sequence
  Description of Artificial Sequence: Synthetic oligonucleotide
  Target: SOD1; (+) strand; PAM type: NRG; PAM sequence: AGG
cttttcgggttcaacggatg

SEQ ID NO: 11327 - DNA, 20 bp, Artificial Sequence
  Description of Artificial Sequence: Synthetic oligonucleotide
  Target: SOD1; (+) strand; PAM type: NRG; PAM sequence: TAG
ttcgggttcaacggatgagg

SEQ ID NO: 11328 - DNA, 20 bp, Artificial Sequence
  Description of Artificial Sequence: Synthetic oligonucleotide
  Target: SOD1; (+) strand; PAM type: NRG; PAM sequence: CAG
ttcaacggatgaggtagcct

SEQ ID NO: 11329 - DNA, 20 bp, Artificial Sequence
  Description of Artificial Sequence: Synthetic oligonucleotide
  Target: SOD1; (+) strand; PAM type: NRG; PAM sequence: CAG
aacggatgaggtagcctcag

SEQ ID NO: 11330 - DNA, 20 bp, Artificial Sequence
  Description of Artificial Sequence: Synthetic oligonucleotide
  Target: SOD1; (+) strand; PAM type: NRG; PAM sequence: AGG
acggatgaggtagcctcagc

SEQ ID NO: 11331 - DNA, 20 bp, Artificial Sequence
  Description of Artificial Sequence: Synthetic oligonucleotide
  Target: SOD1; (+) strand; PAM type: NRG; PAM sequence: CAG
agcctcagcaggtaactctt

SEQ ID NO: 11332 - DNA, 20 bp, Artificial Sequence
  Description of Artificial Sequence: Synthetic oligonucleotide
  Target: SOD1; (+) strand; PAM type: NRG; PAM sequence: AAG
ctcagcaggtaactcttcag

SEQ ID NO: 11333 - DNA, 20 bp, Artificial Sequence
  Description of Artificial Sequence: Synthetic oligonucleotide
  Target: SOD1; (+) strand; PAM type: NRG; PAM sequence: AGG
tcagcaggtaactcttcaga

SEQ ID NO: 11334 - DNA, 20 bp, Artificial Sequence
  Description of Artificial Sequence: Synthetic oligonucleotide
  Target: SOD1; (+) strand; PAM type: NRG; PAM sequence: TAG
ggtaactcttcagaaggctt

SEQ ID NO: 11335 - DNA, 20 bp, Artificial Sequence
  Description of Artificial Sequence: Synthetic oligonucleotide
  Target: SOD1; (+) strand; PAM type: NRG; PAM sequence: AGG
gtaactcttcagaaggcttt

SEQ ID NO: 11336 - DNA, 20 bp, Artificial Sequence
  Description of Artificial Sequence: Synthetic oligonucleotide
  Target: SOD1; (+) strand; PAM type: NRG; PAM sequence: CAG
ttcagaaggctttaggactg

SEQ ID NO: 11337 - DNA, 20 bp, Artificial Sequence
  Description of Artificial Sequence: Synthetic oligonucleotide
  Target: SOD1; (+) strand; PAM type: NRG; PAM sequence: CAG
aggctttaggactgcagcct

SEQ ID NO: 11338 - DNA, 20 bp, Artificial Sequence
  Description of Artificial Sequence: Synthetic oligonucleotide
  Target: SOD1; (+) strand; PAM type: NRG; PAM sequence: AAG
gcctcagacacccccttctc

SEQ ID NO: 11339 - DNA, 20 bp, Artificial Sequence
  Description of Artificial Sequence: Synthetic oligonucleotide
  Target: SOD1; (+) strand; PAM type: NRG; PAM sequence: AAG
cacccccttctcaagttctg

SEQ ID NO: 11340 - DNA, 20 bp, Artificial Sequence
  Description of Artificial Sequence: Synthetic oligonucleotide
  Target: SOD1; (+) strand; PAM type: NRG; PAM sequence: CAG
ccccttctcaagttctgaag

SEQ ID NO: 11341 - DNA, 20 bp, Artificial Sequence
  Description of Artificial Sequence: Synthetic oligonucleotide
  Target: SOD1; (+) strand; PAM type: NRG; PAM sequence: TGG
cagtgtctacatttcccact

SEQ ID NO: 11342 - DNA, 20 bp, Artificial Sequence
  Description of Artificial Sequence: Synthetic oligonucleotide
  Target: SOD1; (+) strand; PAM type: NRG; PAM sequence: TGG
tacatttcccacttggctaa

SEQ ID NO: 11343 - DNA, 20 bp, Artificial Sequence
  Description of Artificial Sequence: Synthetic oligonucleotide
  Target: SOD1; (+) strand; PAM type: NRG; PAM sequence: GGG
acatttcccacttggctaat

SEQ ID NO: 11344 - DNA, 20 bp, Artificial Sequence
  Description of Artificial Sequence: Synthetic oligonucleotide
  Target: SOD1; (+) strand; PAM type: NRG; PAM sequence: GAG
atttcccacttggctaatgg

SEQ ID NO: 11345 - DNA, 20 bp, Artificial Sequence
  Description of Artificial Sequence: Synthetic oligonucleotide
  Target: SOD1; (+) strand; PAM type: NRG; PAM sequence: AGG
tttcccacttggctaatggg

SEQ ID NO: 11346 - DNA, 20 bp, Artificial Sequence
  Description of Artificial Sequence: Synthetic oligonucleotide
  Target: SOD1; (+) strand; PAM type: NRG; PAM sequence: CGG
ttggctaatgggaggttcaa

SEQ ID NO: 11347 - DNA, 20 bp, Artificial Sequence
  Description of Artificial Sequence: Synthetic oligonucleotide
  Target: SOD1; (+) strand; PAM type: NRG; PAM sequence: CAG
acctgccctgtctgtcacct

SEQ ID NO: 11348 - DNA, 20 bp, Artificial Sequence
  Description of Artificial Sequence: Synthetic oligonucleotide
  Target: SOD1; (+) strand; PAM type: NRG; PAM sequence: AGG
cctgccctgtctgtcacctc

SEQ ID NO: 11349 - DNA, 20 bp, Artificial Sequence
  Description of Artificial Sequence: Synthetic oligonucleotide
  Target: SOD1; (+) strand; PAM type: NRG; PAM sequence: CGG
cctcaggcttttcctttcct

SEQ ID NO: 11350 - DNA, 20 bp, Artificial Sequence
  Description of Artificial Sequence: Synthetic oligonucleotide
  Target: SOD1; (+) strand; PAM type: NRG; PAM sequence: GGG
ctcaggcttttcctttcctc

SEQ ID NO: 11351 - DNA, 20 bp, Artificial Sequence
  Description of Artificial Sequence: Synthetic oligonucleotide
  Target: SOD1; (+) strand; PAM type: NRG; PAM sequence: GAG
ggcttcttccttctctctac

SEQ ID NO: 11352 - DNA, 20 bp, Artificial Sequence
  Description of Artificial Sequence: Synthetic oligonucleotide
  Target: SOD1; (+) strand; PAM type: NRG; PAM sequence: TAG
tctacgagactctctatctc

SEQ ID NO: 11353 - DNA, 20 bp, Artificial Sequence
  Description of Artificial Sequence: Synthetic oligonucleotide
  Target: SOD1; (+) strand; PAM type: NRG; PAM sequence: TAG
ctctctgtctcgatgcccac

SEQ ID NO: 11354 - DNA, 20 bp, Artificial Sequence
  Description of Artificial Sequence: Synthetic oligonucleotide
  Target: SOD1; (+) strand; PAM type: NRG; PAM sequence: GAG
ctctgtctcgatgcccacta

SEQ ID NO: 11355 - DNA, 20 bp, Artificial Sequence
  Description of Artificial Sequence: Synthetic oligonucleotide
  Target: SOD1; (+) strand; PAM type: NRG; PAM sequence: AAG
agcgtctatttctctcttcc

SEQ ID NO: 11356 - DNA, 20 bp, Artificial Sequence
  Description of Artificial Sequence: Synthetic oligonucleotide
  Target: SOD1; (+) strand; PAM type: NRG; PAM sequence: CGG
ccaagtctctgtgcctgtcc

SEQ ID NO: 11357 - DNA, 20 bp, Artificial Sequence
  Description of Artificial Sequence: Synthetic oligonucleotide
  Target: SOD1; (+) strand; PAM type: NRG; PAM sequence: CAG
gtctctgtgcctgtcccggt

SEQ ID NO: 11358 - DNA, 20 bp, Artificial Sequence
  Description of Artificial Sequence: Synthetic oligonucleotide
  Target: SOD1; (+) strand; PAM type: NRG; PAM sequence: AGG
tctctgtgcctgtcccggtc

SEQ ID NO: 11359 - DNA, 20 bp, Artificial Sequence
  Description of Artificial Sequence: Synthetic oligonucleotide
  Target: SOD1; (+) strand; PAM type: NRG; PAM sequence: GGG
ctctgtgcctgtcccggtca

SEQ ID NO: 11360 - DNA, 20 bp, Artificial Sequence
  Description of Artificial Sequence: Synthetic oligonucleotide
  Target: SOD1; (+) strand; PAM type: NRG; PAM sequence: CGG
ttccccactctctcctgtca

SEQ ID NO: 11361 - DNA, 20 bp, Artificial Sequence
  Description of Artificial Sequence: Synthetic oligonucleotide
  Target: SOD1; (+) strand; PAM type: NRG; PAM sequence: CGG
tattatctctatcatcatta

SEQ ID NO: 11362 - DNA, 20 bp, Artificial Sequence
  Description of Artificial Sequence: Synthetic oligonucleotide
  Target: SOD1; (+) strand; PAM type: NRG; PAM sequence: CGG
tacggttcccataccgttcc

SEQ ID NO: 11363 - DNA, 20 bp, Artificial Sequence
  Description of Artificial Sequence: Synthetic oligonucleotide
  Target: SOD1; (+) strand; PAM type: NRG; PAM sequence: AAG
attttccaccctatttccaa

SEQ ID NO: 11364 - DNA, 20 bp, Artificial Sequence
  Description of Artificial Sequence: Synthetic oligonucleotide
  Target: SOD1; (+) strand; PAM type: NRG; PAM sequence: TGG
atcttcttccaaacctttct

SEQ ID NO: 11365 - DNA, 20 bp, Artificial Sequence
  Description of Artificial Sequence: Synthetic oligonucleotide
  Target: SOD1; (+) strand; PAM type: NRG; PAM sequence: TGG
ttatcatttctaaactgctg

SEQ ID NO: 11366 - DNA, 20 bp, Artificial Sequence
  Description of Artificial Sequence: Synthetic oligonucleotide
  Target: SOD1; (+) strand; PAM type: NRG; PAM sequence: TGG
tgctgtggctgctgctgtgt

SEQ ID NO: 11367 - DNA, 20 bp, Artificial Sequence
  Description of Artificial Sequence: Synthetic oligonucleotide
  Target: SOD1; (+) strand; PAM type: NRG; PAM sequence: TGG
tgtggctgctgctgtgttgg

SEQ ID NO: 11368 - DNA, 20 bp, Artificial Sequence
  Description of Artificial Sequence: Synthetic oligonucleotide
  Target: SOD1; (+) strand; PAM type: NRG; PAM sequence: GAG
tggctgctgctgtgttggtg

SEQ ID NO: 11369 - DNA, 20 bp, Artificial Sequence
  Description of Artificial Sequence: Synthetic oligonucleotide
  Target: SOD1; (+) strand; PAM type: NRG; PAM sequence: AGG
ggctgctgctgtgttggtgg

SEQ ID NO: 11370 - DNA, 20 bp, Artificial Sequence
  Description of Artificial Sequence: Synthetic oligonucleotide
  Target: SOD1; (+) strand; PAM type: NRG; PAM sequence: TGG
gttggtggaggctgttgtga

SEQ ID NO: 11371 - DNA, 20 bp, Artificial Sequence
  Description of Artificial Sequence: Synthetic oligonucleotide
  Target: SOD1; (+) strand; PAM type: NRG; PAM sequence: TGG
ggtggaggctgttgtgatgg

SEQ ID NO: 11372 - DNA, 20 bp, Artificial Sequence
  Description of Artificial Sequence: Synthetic oligonucleotide
  Target: SOD1; (+) strand; PAM type: NRG; PAM sequence: TGG
ggaggctgttgtgatggtgg

SEQ ID NO: 11373 - DNA, 20 bp, Artificial Sequence
  Description of Artificial Sequence: Synthetic oligonucleotide
  Target: SOD1; (+) strand; PAM type: NRG; PAM sequence: TGG
tgctgctgctgctgctgctg

SEQ ID NO: 11374 - DNA, 20 bp, Artificial Sequence
  Description of Artificial Sequence: Synthetic oligonucleotide
  Target: SOD1; (+) strand; PAM type: NRG; PAM sequence: TGG
gctgctgctgctgtggttgc

SEQ ID NO: 11375 - DNA, 20 bp, Artificial Sequence
  Description of Artificial Sequence: Synthetic oligonucleotide
  Target: SOD1; (+) strand; PAM type: NRG; PAM sequence: GGG
ctgctgctgctgtggttgct

SEQ ID NO: 11376 - DNA, 20 bp, Artificial Sequence
  Description of Artificial Sequence: Synthetic oligonucleotide
  Target: SOD1; (+) strand; PAM type: NRG; PAM sequence: GGG
tgctgctgctgtggttgctg

SEQ ID NO: 11377 - DNA, 20 bp, Artificial Sequence
  Description of Artificial Sequence: Synthetic oligonucleotide
  Target: SOD1; (+) strand; PAM type: NRG; PAM sequence: CGG
tgtggttgctggggcgcctg

SEQ ID NO: 11378 - DNA, 20 bp, Artificial Sequence
  Description of Artificial Sequence: Synthetic oligonucleotide
  Target: SOD1; (+) strand; PAM type: NRG; PAM sequence: TGG
tgctggggcgcctgcggctg

SEQ ID NO: 11379 - DNA, 20 bp, Artificial Sequence
  Description of Artificial Sequence: Synthetic oligonucleotide
  Target: SOD1; (+) strand; PAM type: NRG; PAM sequence: TGG
tgcggctgtggctgctgctg

SEQ ID NO: 11380 - DNA, 20 bp, Artificial Sequence
  Description of Artificial Sequence: Synthetic oligonucleotide
  Target: SOD1; (+) strand; PAM type: NRG; PAM sequence: CGG
ggctgctgctgtggctgctg

SEQ ID NO: 11381 - DNA, 20 bp, Artificial Sequence
  Description of Artificial Sequence: Synthetic oligonucleotide
  Target: SOD1; (+) strand; PAM type: NRG; PAM sequence: CGG
tgctgctgtggctgctgcgg

SEQ ID NO: 11382 - DNA, 20 bp, Artificial Sequence
  Description of Artificial Sequence: Synthetic oligonucleotide
  Target: SOD1; (+) strand; PAM type: NRG; PAM sequence: CAG
ttgccttccgtctctgtctt

SEQ ID NO: 11383 - DNA, 20 bp, Artificial Sequence
  Description of Artificial Sequence: Synthetic oligonucleotide
  Target: SOD1; (+) strand; PAM type: NRG; PAM sequence: AGG
tgccttccgtctctgtcttc

SEQ ID NO: 11384 - DNA, 20 bp, Artificial Sequence
  Description of Artificial Sequence: Synthetic oligonucleotide
  Target: SOD1; (+) strand; PAM type: NRG; PAM sequence: TGG
tctctgtcttcaggaccccc

SEQ ID NO: 11385 - DNA, 20 bp, Artificial Sequence
  Description of Artificial Sequence: Synthetic oligonucleotide
  Target: SOD1; (+) strand; PAM type: NRG; PAM sequence: GGG
ctctgtcttcaggaccccct

SEQ ID NO: 11386 - DNA, 20 bp, Artificial Sequence
  Description of Artificial Sequence: Synthetic oligonucleotide
  Target: SOD1; (+) strand; PAM type: NRG; PAM sequence: TGG
tcttcaggaccccctgggcc

SEQ ID NO: 11387 - DNA, 20 bp, Artificial Sequence
  Description of Artificial Sequence: Synthetic oligonucleotide
  Target: SOD1; (+) strand; PAM type: NRG; PAM sequence: TGG
ggaccccctgggcctggccc

SEQ ID NO: 11388 - DNA, 20 bp, Artificial Sequence
  Description of Artificial Sequence: Synthetic oligonucleotide
  Target: SOD1; (+) strand; PAM type: NRG; PAM sequence: GGG
gaccccctgggcctggccct

SEQ ID NO: 11389 - DNA, 20 bp, Artificial Sequence
  Description of Artificial Sequence: Synthetic oligonucleotide
  Target: SOD1; (+) strand; PAM type: NRG; PAM sequence: GAG
gggcctggccctgggccccc

SEQ ID NO: 11390 - DNA, 20 bp, Artificial Sequence
  Description of Artificial Sequence: Synthetic oligonucleotide
  Target: SOD1; (+) strand; PAM type: NRG; PAM sequence: TGG
ggccctgggcccccgagccc

SEQ ID NO: 11391 - DNA, 20 bp, Artificial Sequence
  Description of Artificial Sequence: Synthetic oligonucleotide
  Target: SOD1; (+) strand; PAM type: NRG; PAM sequence: CAG
cccgagccctggcattccac

SEQ ID NO: 11392 - DNA, 20 bp, Artificial Sequence
  Description of Artificial Sequence: Synthetic oligonucleotide
  Target: SOD1; (+) strand; PAM type: NRG; PAM sequence: AGG
ccgagccctggcattccacc

SEQ ID NO: 11393 - DNA, 20 bp, Artificial Sequence
  Description of Artificial Sequence: Synthetic oligonucleotide
  Target: SOD1; (+) strand; PAM type: NRG; PAM sequence: AAG
gcattccaccaggcctaaca

SEQ ID NO: 11394 - DNA, 20 bp, Artificial Sequence
  Description of Artificial Sequence: Synthetic oligonucleotide
  Target: SOD1; (+) strand; PAM type: NRG; PAM sequence: AGG
cattccaccaggcctaacaa

SEQ ID NO: 11395 - DNA, 20 bp, Artificial Sequence
  Description of Artificial Sequence: Synthetic oligonucleotide
  Target: SOD1; (+) strand; PAM type: NRG; PAM sequence: GGG
attccaccaggcctaacaaa

SEQ ID NO: 11396 - DNA, 20 bp, Artificial Sequence
  Description of Artificial Sequence: Synthetic oligonucleotide
  Target: SOD1; (+) strand; PAM type: NRG; PAM sequence: GGG
ttccaccaggcctaacaaag

SEQ ID NO: 11397 - DNA, 20 bp, Artificial Sequence
  Description of Artificial Sequence: Synthetic oligonucleotide
  Target: SOD1; (+) strand; PAM type: NRG; PAM sequence: CGG
ggcctaacaaaggggccatg

SEQ ID NO: 11398 - DNA, 20 bp, Artificial Sequence
  Description of Artificial Sequence: Synthetic oligonucleotide
  Target: SOD1; (+) strand; PAM type: NRG; PAM sequence: TGG
ctaacaaaggggccatgcgg

SEQ ID NO: 11399 - DNA, 20 bp, Artificial Sequence
  Description of Artificial Sequence: Synthetic oligonucleotide
  Target: SOD1; (+) strand; PAM type: NRG; PAM sequence: GGG
taacaaaggggccatgcggt

SEQ ID NO: 11400 - DNA, 20 bp, Artificial Sequence
  Description of Artificial Sequence: Synthetic oligonucleotide
  Target: SOD1; (+) strand; PAM type: NRG; PAM sequence: AAG
caaaggggccatgcggtggg

SEQ ID NO: 11401 - DNA, 20 bp, Artificial Sequence
  Description of Artificial Sequence: Synthetic oligonucleotide
  Target: SOD1; (+) strand; PAM type: NRG; PAM sequence: AGG
aaaggggccatgcggtggga

SEQ ID NO: 11402 - DNA, 20 bp, Artificial Sequence
  Description of Artificial Sequence: Synthetic oligonucleotide
  Target: SOD1; (+) strand; PAM type: NRG; PAM sequence: GGG
aaggggccatgcggtgggaa

SEQ ID NO: 11403 - DNA, 20 bp, Artificial Sequence
  Description of Artificial Sequence: Synthetic oligonucleotide
  Target: SOD1; (+) strand; PAM type: NRG; PAM sequence: GAG
gaagggacctttcattccat

SEQ ID NO: 11404 - DNA, 20 bp, Artificial Sequence
  Description of Artificial Sequence: Synthetic oligonucleotide
  Target: SOD1; (+) strand; PAM type: NRG; PAM sequence: AGG
aagggacctttcattccatg

SEQ ID NO: 11405 - DNA, 20 bp, Artificial Sequence
  Description of Artificial Sequence: Synthetic oligonucleotide
  Target: SOD1; (+) strand; PAM type: NRG; PAM sequence: TGG
ggacctttcattccatgagg

SEQ ID NO: 11406 - DNA, 20 bp, Artificial Sequence
  Description of Artificial Sequence: Synthetic oligonucleotide
  Target: SOD1; (+) strand; PAM type: NRG; PAM sequence: GAG
acctttcattccatgaggtg

SEQ ID NO: 11407 - DNA, 20 bp, Artificial Sequence
  Description of Artificial Sequence: Synthetic oligonucleotide
  Target: SOD1; (+) strand; PAM type: NRG; PAM sequence: AGG
cctttcattccatgaggtgg

SEQ ID NO: 11408 - DNA, 20 bp, Artificial Sequence
  Description of Artificial Sequence: Synthetic oligonucleotide
  Target: SOD1; (+) strand; PAM type: NRG; PAM sequence: AAG
catgaggtggaggcatcgca

SEQ ID NO: 11409 - DNA, 20 bp, Artificial Sequence
  Description of Artificial Sequence: Synthetic oligonucleotide
  Target: SOD1; (+) strand; PAM type: NRG; PAM sequence: TGG
ggaggcatcgcaaagccccc

SEQ ID NO: 11410 - DNA, 20 bp, Artificial Sequence
  Description of Artificial Sequence: Synthetic oligonucleotide
  Target: SOD1; (+) strand; PAM type: NRG; PAM sequence: TGG
atcgcaaagccccctggtcc

SEQ ID NO: 11411 - DNA, 20 bp, Artificial Sequence
  Description of Artificial Sequence: Synthetic oligonucleotide
  Target: SOD1; (+) strand; PAM type: NRG; PAM sequence: CGG
gcaaagccccctggtcctgg

SEQ ID NO: 11412 - DNA, 20 bp, Artificial Sequence
  Description of Artificial Sequence: Synthetic oligonucleotide
  Target: SOD1; (+) strand; PAM type: NRG; PAM sequence: TGG
aagccccctggtcctggcgg

SEQ ID NO: 11413 - DNA, 20 bp, Artificial Sequence
  Description of Artificial Sequence: Synthetic oligonucleotide
  Target: SOD1; (+) strand; PAM type: NRG; PAM sequence: GGG
agccccctggtcctggcggt

SEQ ID NO: 11414 - DNA, 20 bp, Artificial Sequence
  Description of Artificial Sequence: Synthetic oligonucleotide
  Target: SOD1; (+) strand; PAM type: NRG; PAM sequence: CGG
gggcctctgtgcatcatgtg

SEQ ID NO: 11415 - DNA, 20 bp, Artificial Sequence
  Description of Artificial Sequence: Synthetic oligonucleotide
  Target: SOD1; (+) strand; PAM type: NRG; PAM sequence: TGG
cctctgtgcatcatgtgcgg

SEQ ID NO: 11416 - DNA, 20 bp, Artificial Sequence
  Description of Artificial Sequence: Synthetic oligonucleotide
  Target: SOD1; (+) strand; PAM type: NRG; PAM sequence: TGG
gtgcatcatgtgcggtggca

SEQ ID NO: 11417 - DNA, 20 bp, Artificial Sequence
  Description of Artificial Sequence: Synthetic oligonucleotide
  Target: SOD1; (+) strand; PAM type: NRG; PAM sequence: GGG
tgcatcatgtgcggtggcat

SEQ ID NO: 11418 - DNA, 20 bp, Artificial Sequence
  Description of Artificial Sequence: Synthetic oligonucleotide
  Target: SOD1; (+) strand; PAM type: NRG; PAM sequence: CGG
tcatgtgcggtggcatggga

SEQ ID NO: 11419 - DNA, 20 bp, Artificial Sequence
  Description of Artificial Sequence: Synthetic oligonucleotide
  Target: SOD1; (+) strand; PAM type: NRG; PAM sequence: GGG
catgtgcggtggcatgggac

SEQ ID NO: 11420 - DNA, 20 bp, Artificial Sequence
  Description of Artificial Sequence: Synthetic oligonucleotide
  Target: SOD1; (+) strand; PAM type: NRG; PAM sequence: GGG
atgtgcggtggcatgggacg

SEQ ID NO: 11421 - DNA, 20 bp, Artificial Sequence
  Description of Artificial Sequence: Synthetic oligonucleotide
  Target: SOD1; (+) strand; PAM type: NRG; PAM sequence: CGG
tgcggtggcatgggacgggg

SEQ ID NO: 11422 - DNA, 20 bp, Artificial Sequence
  Description of Artificial Sequence: Synthetic oligonucleotide
  Target: SOD1; (+) strand; PAM type: NRG; PAM sequence: AAG
catgggacggggcggcatca

SEQ ID NO: 11423 - DNA, 20 bp, Artificial Sequence
  Description of Artificial Sequence: Synthetic oligonucleotide
  Target: SOD1; (+) strand; PAM type: NRG; PAM sequence: AGG
atgggacggggcggcatcaa

SEQ ID NO: 11424 - DNA, 20 bp, Artificial Sequence
  Description of Artificial Sequence: Synthetic oligonucleotide
  Target: SOD1; (+) strand; PAM type: NRG; PAM sequence: GGG
tgggacggggcggcatcaaa

SEQ ID NO: 11425 - DNA, 20 bp, Artificial Sequence
  Description of Artificial Sequence: Synthetic oligonucleotide
  Target: SOD1; (+) strand; PAM type: NRG; PAM sequence: AAG
gcatcaaagggaaccgctgt

SEQ ID NO: 11426 - DNA, 20 bp, Artificial Sequence
  Description of Artificial Sequence: Synthetic oligonucleotide
  Target: SOD1; (+) strand; PAM type: NRG; PAM sequence: GAG
caaagggaaccgctgtaagt

SEQ ID NO: 11427 - DNA, 20 bp, Artificial Sequence
  Description of Artificial Sequence: Synthetic oligonucleotide
  Target: SOD1; (+) strand; PAM type: NRG; PAM sequence: AGG
aaagggaaccgctgtaagtg

SEQ ID NO: 11428 - DNA, 20 bp, Artificial Sequence
  Description of Artificial Sequence: Synthetic oligonucleotide
  Target: SOD1; (+) strand; PAM type: NRG; PAM sequence: TGG
gggaaccgctgtaagtgagg

SEQ ID NO: 11429 - DNA, 20 bp, Artificial Sequence
  Description of Artificial Sequence: Synthetic oligonucleotide
  Target: SOD1; (+) strand; PAM type: NRG; PAM sequence: GGG
ggaaccgctgtaagtgaggt

SEQ ID NO: 11430 - DNA, 20 bp, Artificial Sequence
  Description of Artificial Sequence: Synthetic oligonucleotide
  Target: SOD1; (+) strand; PAM type: NRG; PAM sequence: GGG
gaaccgctgtaagtgaggtg

SEQ ID NO: 11431 - DNA, 20 bp, Artificial Sequence
  Description of Artificial Sequence: Synthetic oligonucleotide
  Target: SOD1; (+) strand; PAM type: NRG; PAM sequence: GGG
aaccgctgtaagtgaggtgg

SEQ ID NO: 11432 - DNA, 20 bp, Artificial Sequence
  Description of Artificial Sequence: Synthetic oligonucleotide
  Target: SOD1; (+) strand; PAM type: NRG; PAM sequence: TGG
aagtgaggtgggggcattcc

SEQ ID NO: 11433 - DNA, 20 bp, Artificial Sequence
  Description of Artificial Sequence: Synthetic oligonucleotide
  Target: SOD1; (+) strand; PAM type: NRG; PAM sequence: GAG
gtgaggtgggggcattcctg

SEQ ID NO: 11434 - DNA, 20 bp, Artificial Sequence
  Description of Artificial Sequence: Synthetic oligonucleotide
  Target: SOD1; (+) strand; PAM type: NRG; PAM sequence: AGG
tgaggtgggggcattcctgg

SEQ ID NO: 11435 - DNA, 20 bp, Artificial Sequence
  Description of Artificial Sequence: Synthetic oligonucleotide
  Target: SOD1; (+) strand; PAM type: NRG; PAM sequence: GGG
gaggtgggggcattcctgga

SEQ ID NO: 11436 - DNA, 20 bp, Artificial Sequence
  Description of Artificial Sequence: Synthetic oligonucleotide
  Target: SOD1; (+) strand; PAM type: NRG; PAM sequence: TGG
ggggcattcctggagggcgc

SEQ ID NO: 11437 - DNA, 20 bp, Artificial Sequence
  Description of Artificial Sequence: Synthetic oligonucleotide
  Target: SOD1; (+) strand; PAM type: NRG; PAM sequence: GAG
ggcattcctggagggcgctg

SEQ ID NO: 11438 - DNA, 20 bp, Artificial Sequence
  Description of Artificial Sequence: Synthetic oligonucleotide
  Target: SOD1; (+) strand; PAM type: NRG; PAM sequence: TGG
attcctggagggcgctggag

SEQ ID NO: 11439 - DNA, 20 bp, Artificial Sequence
  Description of Artificial Sequence: Synthetic oligonucleotide
  Target: SOD1; (+) strand; PAM type: NRG; PAM sequence: GGG
ttcctggagggcgctggagt

SEQ ID NO: 11440 - DNA, 20 bp, Artificial Sequence
  Description of Artificial Sequence: Synthetic oligonucleotide
  Target: SOD1; (+) strand; PAM type: NRG; PAM sequence: GAG
ggagggcgctggagtgggat

SEQ ID NO: 11441 - DNA, 20 bp, Artificial Sequence
  Description of Artificial Sequence: Synthetic oligonucleotide
  Target: SOD1; (+) strand; PAM type: NRG; PAM sequence: CGG
gcgctggagtgggatgagac

SEQ ID NO: 11442 - DNA, 20 bp, Artificial Sequence
  Description of Artificial Sequence: Synthetic oligonucleotide
  Target: SOD1; (+) strand; PAM type: NRG; PAM sequence: GGG
cgctggagtgggatgagacc

SEQ ID NO: 11443 - DNA, 20 bp, Artificial Sequence
  Description of Artificial Sequence: Synthetic oligonucleotide
  Target: SOD1; (+) strand; PAM type: NRG; PAM sequence: CGG
ggagtgggatgagaccgggc

SEQ ID NO: 11444 - DNA, 20 bp, Artificial Sequence
  Description of Artificial Sequence: Synthetic oligonucleotide
  Target: SOD1; (+) strand; PAM type: NRG; PAM sequence: GGG
gagtgggatgagaccgggcc

SEQ ID NO: 11445 - DNA, 20 bp, Artificial Sequence
  Description of Artificial Sequence: Synthetic oligonucleotide
  Target: SOD1; (+) strand; PAM type: NRG; PAM sequence: AAG
atgagaccgggccgggcgcc

SEQ ID NO: 11446 - DNA, 20 bp, Artificial Sequence
  Description of Artificial Sequence: Synthetic oligonucleotide
  Target: SOD1; (+) strand; PAM type: NRG; PAM sequence: AAG
agaccgggccgggcgccaag

SEQ ID NO: 11447 - DNA, 20 bp, Artificial Sequence
  Description of Artificial Sequence: Synthetic oligonucleotide
  Target: SOD1; (+) strand; PAM type: NRG; PAM sequence: CAG
gggccgggcgccaagaagac

SEQ ID NO: 11448 - DNA, 20 bp, Artificial Sequence
  Description of Artificial Sequence: Synthetic oligonucleotide
  Target: SOD1; (+) strand; PAM type: NRG; PAM sequence: TAG
ccgggcgccaagaagaccag

SEQ ID NO: 11449 - DNA, 20 bp, Artificial Sequence
  Description of Artificial Sequence: Synthetic oligonucleotide
  Target: SOD1; (+) strand; PAM type: NRG; PAM sequence: TGG
gcgccaagaagaccagtaga

SEQ ID NO: 11450 - DNA, 20 bp, Artificial Sequence
  Description of Artificial Sequence: Synthetic oligonucleotide
  Target: SOD1; (+) strand; PAM type: NRG; PAM sequence: AAG
agaccagtagatggtgcctg

SEQ ID NO: 11451 - DNA, 20 bp, Artificial Sequence
  Description of Artificial Sequence: Synthetic oligonucleotide
  Target: SOD1; (+) strand; PAM type: NRG; PAM sequence: CAG
tggtgcctgaagtccaatta

SEQ ID NO: 11452 - DNA, 20 bp, Artificial Sequence
  Description of Artificial Sequence: Synthetic oligonucleotide
  Target: SOD1; (+) strand; PAM type: NRG; PAM sequence: AGG
ggtgcctgaagtccaattac

SEQ ID NO: 11453 - DNA, 20 bp, Artificial Sequence
  Description of Artificial Sequence: Synthetic oligonucleotide
  Target: SOD1; (+) strand; PAM type: NRG; PAM sequence: CAG
ctgaagtccaattacaggac

SEQ ID NO: 11454 - DNA, 20 bp, Artificial Sequence
  Description of Artificial Sequence: Synthetic oligonucleotide
  Target: SOD1; (+) strand; PAM type: NRG; PAM sequence: AGG
tgaagtccaattacaggacc

SEQ ID NO: 11455 - DNA, 20 bp, Artificial Sequence
  Description of Artificial Sequence: Synthetic oligonucleotide
  Target: SOD1; (+) strand; PAM type: NRG; PAM sequence: GGG
gaagtccaattacaggacca

SEQ ID NO: 11456 - DNA, 20 bp, Artificial Sequence
  Description of Artificial Sequence: Synthetic oligonucleotide
  Target: SOD1; (+) strand; PAM type: NRG; PAM sequence: GGG
aagtccaattacaggaccag

SEQ ID NO: 11457 - DNA, 20 bp, Artificial Sequence
  Description of Artificial Sequence: Synthetic oligonucleotide
  Target: SOD1; (+) strand; PAM type: NRG; PAM sequence: GAG
aggaccaggggcaactcctt

SEQ ID NO: 11458 - DNA, 20 bp, Artificial Sequence
  Description of Artificial Sequence: Synthetic oligonucleotide
  Target: SOD1; (+) strand; PAM type: NRG; PAM sequence: AAG
gcaactccttgagtgcctaa

SEQ ID NO: 11459 - DNA, 20 bp, Artificial Sequence
  Description of Artificial Sequence: Synthetic oligonucleotide
  Target: SOD1; (+) strand; PAM type: NRG; PAM sequence: AAG
taaaaatgtaaacaccaccg

SEQ ID NO: 11460 - DNA, 20 bp, Artificial Sequence
  Description of Artificial Sequence: Synthetic oligonucleotide
  Target: SOD1; (+) strand; PAM type: NRG; PAM sequence: TGG
aatgtaaacaccaccgaaga

SEQ ID NO: 11461 - DNA, 20 bp, Artificial Sequence
  Description of Artificial Sequence: Synthetic oligonucleotide
  Target: SOD1; (+) strand; PAM type: NRG; PAM sequence: CAG
caccaccgaagatggcactc

SEQ ID NO: 11462 - DNA, 20 bp, Artificial Sequence
  Description of Artificial Sequence: Synthetic oligonucleotide
  Target: SOD1; (+) strand; PAM type: NRG; PAM sequence: CAG
cgaagatggcactccagttt

SEQ ID NO: 11463 - DNA, 20 bp, Artificial Sequence
  Description of Artificial Sequence: Synthetic oligonucleotide
  Target: SOD1; (+) strand; PAM type: NRG; PAM sequence: TGG
ccagtttcagctgtgttctg

SEQ ID NO: 11464 - DNA, 20 bp, Artificial Sequence
  Description of Artificial Sequence: Synthetic oligonucleotide
  Target: SOD1; (+) strand; PAM type: NRG; PAM sequence: AAG
gctgtgttctgtggcgctta

SEQ ID NO: 11465 - DNA, 20 bp, Artificial Sequence
  Description of Artificial Sequence: Synthetic oligonucleotide
  Target: SOD1; (+) strand; PAM type: NRG; PAM sequence: TAG
cccacaatcttcaaatttca

SEQ ID NO: 11466 - DNA, 20 bp, Artificial Sequence
  Description of Artificial Sequence: Synthetic oligonucleotide
  Target: SOD1; (+) strand; PAM type: NRG; PAM sequence: CAG
ttgccactctgtcacaaacc

SEQ ID NO: 11467 - DNA, 20 bp, Artificial Sequence
  Description of Artificial Sequence: Synthetic oligonucleotide
  Target: SOD1; (+) strand; PAM type: NRG; PAM sequence: GAG
ctctgtcacaaacccagtgt

SEQ ID NO: 11468 - DNA, 20 bp, Artificial Sequence
  Description of Artificial Sequence: Synthetic oligonucleotide
  Target: SOD1; (+) strand; PAM type: NRG; PAM sequence: AGG
tctgtcacaaacccagtgtg

SEQ ID NO: 11469 - DNA, 20 bp, Artificial Sequence
  Description of Artificial Sequence: Synthetic oligonucleotide
  Target: SOD1; (+) strand; PAM type: NRG; PAM sequence: TAG
cacaaacccagtgtgaggcc

SEQ ID NO: 11470 - DNA, 20 bp, Artificial Sequence
  Description of Artificial Sequence: Synthetic oligonucleotide
  Target: SOD1; (+) strand; PAM type: NRG; PAM sequence: AAG
gtgaggcctagtaacaacct

SEQ ID NO: 11471 - DNA, 20 bp, Artificial Sequence
  Description of Artificial Sequence: Synthetic oligonucleotide
  Target: SOD1; (+) strand; PAM type: NRG; PAM sequence: AGG
tgaggcctagtaacaaccta

SEQ ID NO: 11472 - DNA, 20 bp, Artificial Sequence
  Description of Artificial Sequence: Synthetic oligonucleotide
  Target: SOD1; (+) strand; PAM type: NRG; PAM sequence: AAG
gcctagtaacaacctaaggc

SEQ ID NO: 11473 - DNA, 20 bp, Artificial Sequence
  Description of Artificial Sequence: Synthetic oligonucleotide
  Target: SOD1; (+) strand; PAM type: NRG; PAM sequence: AAG
acctaaggcaagcaattgca

SEQ ID NO: 11474 - DNA, 20 bp, Artificial Sequence
  Description of Artificial Sequence: Synthetic oligonucleotide
  Target: SOD1; (+) strand; PAM type: NRG; PAM sequence: AAG
caattgcaaagacattttta

SEQ ID NO: 11475 - DNA, 20 bp, Artificial Sequence
  Description of Artificial Sequence: Synthetic oligonucleotide
  Target: SOD1; (+) strand; PAM type: NRG; PAM sequence: CAG
catttttaaagtatctaata

SEQ ID NO: 11476 - DNA, 20 bp, Artificial Sequence
  Description of Artificial Sequence: Synthetic oligonucleotide
  Target: SOD1; (+) strand; PAM type: NRG; PAM sequence: AGG
atttttaaagtatctaatac

SEQ ID NO: 11477 - DNA, 20 bp, Artificial Sequence
  Description of Artificial Sequence: Synthetic oligonucleotide
  Target: SOD1; (+) strand; PAM type: NRG; PAM sequence: TAG
tttaaagtatctaatacagg

SEQ ID NO: 11478 - DNA, 20 bp, Artificial Sequence
  Description of Artificial Sequence: Synthetic oligonucleotide
  Target: SOD1; (+) strand; PAM type: NRG; PAM sequence: GAG
taaagtatctaatacaggta

SEQ ID NO: 11479 - DNA, 20 bp, Artificial Sequence
  Description of Artificial Sequence: Synthetic oligonucleotide
  Target: SOD1; (+) strand; PAM type: NRG; PAM sequence: AGG
aaagtatctaatacaggtag

SEQ ID NO: 11480 - DNA, 20 bp, Artificial Sequence
  Description of Artificial Sequence: Synthetic oligonucleotide
  Target: SOD1; (+) strand; PAM type: NRG; PAM sequence: CAG
tatctaatacaggtagaggc

SEQ ID NO: 11481 - DNA, 20 bp, Artificial Sequence
  Description of Artificial Sequence: Synthetic oligonucleotide
  Target: SOD1; (+) strand; PAM type: NRG; PAM sequence: TGG
aggtagaggccagaataaac

SEQ ID NO: 11482 - DNA, 20 bp, Artificial Sequence
  Description of Artificial Sequence: Synthetic oligonucleotide
  Target: SOD1; (+) strand; PAM type: NRG; PAM sequence: GGG
ggtagaggccagaataaact

SEQ ID NO: 11483 - DNA, 20 bp, Artificial Sequence
  Description of Artificial Sequence: Synthetic oligonucleotide
  Target: SOD1; (+) strand; PAM type: NRG; PAM sequence: TAG
gaataaactgggaaataaaa

SEQ ID NO: 11484 - DNA, 20 bp, Artificial Sequence
  Description of Artificial Sequence: Synthetic oligonucleotide
  Target: SOD1; (+) strand; PAM type: NRG; PAM sequence: TGG
actgggaaataaaatagtaa

SEQ ID NO: 11485 - DNA, 20 bp, Artificial Sequence
  Description of Artificial Sequence: Synthetic oligonucleotide
  Target: SOD1; (+) strand; PAM type: NRG; PAM sequence: AAG
aatggtaataccaattttca

SEQ ID NO: 11486 - DNA, 20 bp, Artificial Sequence
  Description of Artificial Sequence: Synthetic oligonucleotide
  Target: SOD1; (+) strand; PAM type: NRG; PAM sequence: GAG
tggtaataccaattttcaaa

SEQ ID NO: 11487 - DNA, 20 bp, Artificial Sequence
  Description of Artificial Sequence: Synthetic oligonucleotide
  Target: SOD1; (+) strand; PAM type: NRG; PAM sequence: TAG
gagtatgtcaaaatctcctg

SEQ ID NO: 11488 - DNA, 20 bp, Artificial Sequence
  Description of Artificial Sequence: Synthetic oligonucleotide
  Target: SOD1; (+) strand; PAM type: NRG; PAM sequence: TAG
aaatctcctgtagctttcat

SEQ ID NO: 11489 - DNA, 20 bp, Artificial Sequence
  Description of Artificial Sequence: Synthetic oligonucleotide
  Target: SOD1; (+) strand; PAM type: NRG; PAM sequence: AAG
tctcctgtagctttcattag

SEQ ID NO: 11490 - DNA, 20 bp, Artificial Sequence
  Description of Artificial Sequence: Synthetic oligonucleotide
  Target: SOD1; (+) strand; PAM type: NRG; PAM sequence: GAG
ttcccactccaaatacattt

SEQ ID NO: 11491 - DNA, 20 bp, Artificial Sequence
  Description of Artificial Sequence: Synthetic oligonucleotide
  Target: SOD1; (+) strand; PAM type: NRG; PAM sequence: CAG
ccaaatacatttgagaaaca

SEQ ID NO: 11492 - DNA, 20 bp, Artificial Sequence
  Description of Artificial Sequence: Synthetic oligonucleotide
  Target: SOD1; (+) strand; PAM type: NRG; PAM sequence: AAG
tttgagaaacacagtgtgct

SEQ ID NO: 11493 - DNA, 20 bp, Artificial Sequence
  Description of Artificial Sequence: Synthetic oligonucleotide
  Target: SOD1; (+) strand; PAM type: NRG; PAM sequence: GAG
acagtgtgctaagtcctaat

SEQ ID NO: 11494 - DNA, 20 bp, Artificial Sequence
  Description of Artificial Sequence: Synthetic oligonucleotide
  Target: SOD1; (+) strand; PAM type: NRG; PAM sequence: CAG
gagataaatacattcactat

SEQ ID NO: 11495 - DNA, 20 bp, Artificial Sequence
  Description of Artificial Sequence: Synthetic oligonucleotide
  Target: SOD1; (+) strand; PAM type: NRG; PAM sequence: AAG
ttcactatcagtaactattc

SEQ ID NO: 11496 - DNA, 20 bp, Artificial Sequence
  Description of Artificial Sequence: Synthetic oligonucleotide
  Target: SOD1; (+) strand; PAM type: NRG; PAM sequence: AAG
agtaactattcaagctaact

SEQ ID NO: 11497 - DNA, 20 bp, Artificial Sequence
  Description of Artificial Sequence: Synthetic oligonucleotide
  Target: SOD1; (+) strand; PAM type: NRG; PAM sequence: CAG
caagctaactaagcatactg

SEQ ID NO: 11498 - DNA, 20 bp, Artificial Sequence
  Description of Artificial Sequence: Synthetic oligonucleotide
  Target: SOD1; (+) strand; PAM type: NRG; PAM sequence: AGG
aagctaactaagcatactgc

SEQ ID NO: 11499 - DNA, 20 bp, Artificial Sequence
  Description of Artificial Sequence: Synthetic oligonucleotide
  Target: SOD1; (+) strand; PAM type: NRG; PAM sequence: TAG
gcatactgcaggtgcacact

SEQ ID NO: 11500 - DNA, 20 bp, Artificial Sequence
  Description of Artificial Sequence: Synthetic oligonucleotide
  Target: SOD1; (+) strand; PAM type: NRG; PAM sequence: TAG
tttacaccccgtcttattac

SEQ ID NO: 11501 - DNA, 20 bp, Artificial Sequence
  Description of Artificial Sequence: Synthetic oligonucleotide
  Target: SOD1; (+) strand; PAM type: NRG; PAM sequence: GAG
tcttattactagaaaaaaat

SEQ ID NO: 11502 - DNA, 20 bp, Artificial Sequence
  Description of Artificial Sequence: Synthetic oligonucleotide
  Target: SOD1; (+) strand; PAM type: NRG; PAM sequence: AGG
cttattactagaaaaaaatg

SEQ ID NO: 11503 - DNA, 20 bp, Artificial Sequence
  Description of Artificial Sequence: Synthetic oligonucleotide
  Target: SOD1; (+) strand; PAM type: NRG; PAM sequence: TAG
aaaaaatgaggtcactgacc

SEQ ID NO: 11504 - DNA, 20 bp, Artificial Sequence
  Description of Artificial Sequence: Synthetic oligonucleotide
  Target: SOD1; (+) strand; PAM type: NRG; PAM sequence: CAG
ggtcactgacctagaaaacc

SEQ ID NO: 11505 - DNA, 20 bp, Artificial Sequence
  Description of Artificial Sequence: Synthetic oligonucleotide
  Target: SOD1; (+) strand; PAM type: NRG; PAM sequence: AGG
gtcactgacctagaaaaccc

SEQ ID NO: 11506 - DNA, 20 bp, Artificial Sequence
  Description of Artificial Sequence: Synthetic oligonucleotide
  Target: SOD1; (+) strand; PAM type: NRG; PAM sequence: AAG
ctgacctagaaaacccagga

SEQ ID NO: 11507 - DNA, 20 bp, Artificial Sequence
  Description of Artificial Sequence: Synthetic oligonucleotide
  Target: SOD1; (+) strand; PAM type: NRG; PAM sequence: GAG
gacctagaaaacccaggaaa

SEQ ID NO: 11508 - DNA, 20 bp, Artificial Sequence
  Description of Artificial Sequence: Synthetic oligonucleotide
  Target: SOD1; (+) strand; PAM type: NRG; PAM sequence: AGG
acctagaaaacccaggaaag

SEQ ID NO: 11509 - DNA, 20 bp, Artificial Sequence
  Description of Artificial Sequence: Synthetic oligonucleotide
  Target: SOD1; (+) strand; PAM type: NRG; PAM sequence: AAG
tagaaaacccaggaaagagg

SEQ ID NO: 11510 - DNA, 20 bp, Artificial Sequence
  Description of Artificial Sequence: Synthetic oligonucleotide
  Target: SOD1; (+) strand; PAM type: NRG; PAM sequence: TAG
ctttgactccatgctacact

SEQ ID NO: 11511 - DNA, 20 bp, Artificial Sequence
  Description of Artificial Sequence: Synthetic oligonucleotide
  Target: SOD1; (+) strand; PAM type: NRG; PAM sequence: CAG
tattattaaaatgcctcatg

SEQ ID NO: 11512 - DNA, 20 bp, Artificial Sequence
  Description of Artificial Sequence: Synthetic oligonucleotide
  Target: SOD1; (+) strand; PAM type: NRG; PAM sequence: AAG
acactaatgtctacaaaaca

SEQ ID NO: 11513 - DNA, 20 bp, Artificial Sequence
  Description of Artificial Sequence: Synthetic oligonucleotide
  Target: SOD1; (+) strand; PAM type: NRG; PAM sequence: AAG
aagatccatacacaaatgtg

SEQ ID NO: 11514 - DNA, 20 bp, Artificial Sequence
  Description of Artificial Sequence: Synthetic oligonucleotide
  Target: SOD1; (+) strand; PAM type: NRG; PAM sequence: CAG
aaatgtgaagtttactgtta

SEQ ID NO: 11515 - DNA, 20 bp, Artificial Sequence
  Description of Artificial Sequence: Synthetic oligonucleotide
  Target: SOD1; (+) strand; PAM type: NRG; PAM sequence: AAG
actgttacagttcctttttc

SEQ ID NO: 11516 - DNA, 20 bp, Artificial Sequence
  Description of Artificial Sequence: Synthetic oligonucleotide
  Target: SOD1; (+) strand; PAM type: NRG; PAM sequence: AGG
ctgttacagttcctttttca

SEQ ID NO: 11517 - DNA, 20 bp, Artificial Sequence
  Description of Artificial Sequence: Synthetic oligonucleotide
  Target: SOD1; (+) strand; PAM type: NRG; PAM sequence: CAG
acagttcctttttcaaggca

SEQ ID NO: 11518 - DNA, 20 bp, Artificial Sequence
  Description of Artificial Sequence: Synthetic oligonucleotide
  Target: SOD1; (+) strand; PAM type: NRG; PAM sequence: GAG
cagcatgatatttaacttgc

SEQ ID NO: 11519 - DNA, 20 bp, Artificial Sequence
  Description of Artificial Sequence: Synthetic oligonucleotide
  Target: SOD1; (+) strand; PAM type: NRG; PAM sequence: AGG
agcatgatatttaacttgcg

SEQ ID NO: 11520 - DNA, 20 bp, Artificial Sequence
  Description of Artificial Sequence: Synthetic oligonucleotide
  Target: SOD1; (+) strand; PAM type: NRG; PAM sequence: CAG
cctgaataatgctcaatgtt

SEQ ID NO: 11521 - DNA, 20 bp, Artificial Sequence
  Description of Artificial Sequence: Synthetic oligonucleotide
  Target: SOD1; (+) strand; PAM type: NRG; PAM sequence: AAG
tatttctattcattcttcca

SEQ ID NO: 11522 - DNA, 20 bp, Artificial Sequence
  Description of Artificial Sequence: Synthetic oligonucleotide
  Target: SOD1; (+) strand; PAM type: NRG; PAM sequence: AGG
atttctattcattcttccaa

SEQ ID NO: 11523 - DNA, 20 bp, Artificial Sequence
  Description of Artificial Sequence: Synthetic oligonucleotide
  Target: SOD1; (+) strand; PAM type: NRG; PAM sequence: TGG
tctattcattcttccaaagg

SEQ ID NO: 11524 - DNA, 20 bp, Artificial Sequence
  Description of Artificial Sequence: Synthetic oligonucleotide
  Target: SOD1; (+) strand; PAM type: NRG; PAM sequence: AAG
ttcattcttccaaaggtggc

SEQ ID NO: 11525 - DNA, 20 bp, Artificial Sequence
  Description of Artificial Sequence: Synthetic oligonucleotide
  Target: SOD1; (+) strand; PAM type: NRG; PAM sequence: TGG
tcttccaaaggtggcaagtc

SEQ ID NO: 11526 - DNA, 20 bp, Artificial Sequence
  Description of Artificial Sequence: Synthetic oligonucleotide
  Target: SOD1; (+) strand; PAM type: NRG; PAM sequence: AAG
ccaaaggtggcaagtctggt

SEQ ID NO: 11527 - DNA, 20 bp, Artificial Sequence
  Description of Artificial Sequence: Synthetic oligonucleotide
  Target: SOD1; (+) strand; PAM type: NRG; PAM sequence: AGG
caaaggtggcaagtctggta

SEQ ID NO: 11528 - DNA, 20 bp, Artificial Sequence
  Description of Artificial Sequence: Synthetic oligonucleotide
  Target: SOD1; (+) strand; PAM type: NRG; PAM sequence: TGG
ggtggcaagtctggtaaggt

SEQ ID NO: 11529 - DNA, 20 bp, Artificial Sequence
  Description of Artificial Sequence: Synthetic oligonucleotide
  Target: SOD1; (+) strand; PAM type: NRG; PAM sequence: TGG
ctgaaataacaatgacttct

SEQ ID NO: 11530 - DNA, 20 bp, Artificial Sequence
  Description of Artificial Sequence: Synthetic oligonucleotide
  Target: SOD1; (+) strand; PAM type: NRG; PAM sequence: GAG
ttttattttcctatctacat

SEQ ID NO: 11531 - DNA, 20 bp, Artificial Sequence
  Description of Artificial Sequence: Synthetic oligonucleotide
  Target: SOD1; (+) strand; PAM type: NRG; PAM sequence: AGG
tttattttcctatctacatg

SEQ ID NO: 11532 - DNA, 20 bp, Artificial Sequence
  Description of Artificial Sequence: Synthetic oligonucleotide
  Target: SOD1; (+) strand; PAM type: NRG; PAM sequence: GGG
ttattttcctatctacatga

SEQ ID NO: 11533 - DNA, 20 bp, Artificial Sequence
  Description of Artificial Sequence: Synthetic oligonucleotide
  Target: SOD1; (+) strand; PAM type: NRG; PAM sequence: AAG
gggtttgctcatactgatat

SEQ ID NO: 11534 - DNA, 20 bp, Artificial Sequence
  Description of Artificial Sequence: Synthetic oligonucleotide
  Target: SOD1; (+) strand; PAM type: NRG; PAM sequence: GAG
gtttgctcatactgatataa

SEQ ID NO: 11535 - DNA, 20 bp, Artificial Sequence
  Description of Artificial Sequence: Synthetic oligonucleotide
  Target: SOD1; (+) strand; PAM type: NRG; PAM sequence: AAG
tactgatataagagtcacgc

SEQ ID NO: 11536 - DNA, 20 bp, Artificial Sequence
  Description of Artificial Sequence: Synthetic oligonucleotide
  Target: SOD1; (+) strand; PAM type: NRG; PAM sequence: TGG
acaacctgtcattttctgct

SEQ ID NO: 11537 - DNA, 20 bp, Artificial Sequence
  Description of Artificial Sequence: Synthetic oligonucleotide
  Target: SOD1; (+) strand; PAM type: NRG; PAM sequence: GGG
caacctgtcattttctgctt

SEQ ID NO: 11538 - DNA, 20 bp, Artificial Sequence
  Description of Artificial Sequence: Synthetic oligonucleotide
  Target: SOD1; (+) strand; PAM type: NRG; PAM sequence: GGG
aacctgtcattttctgcttg

SEQ ID NO: 11539 - DNA, 20 bp, Artificial Sequence
  Description of Artificial Sequence: Synthetic oligonucleotide
  Target: SOD1; (+) strand; PAM type: NRG; PAM sequence: TAG
tctgcttggggttcaccact

SEQ ID NO: 11540 - DNA, 20 bp, Artificial Sequence
  Description of Artificial Sequence: Synthetic oligonucleotide
  Target: SOD1; (+) strand; PAM type: NRG; PAM sequence: AGG
ctgcttggggttcaccactt

SEQ ID NO: 11541 - DNA, 20 bp, Artificial Sequence
  Description of Artificial Sequence: Synthetic oligonucleotide
  Target: SOD1; (+) strand; PAM type: NRG; PAM sequence: CAG
tggggttcaccacttaggta

SEQ ID NO: 11542 - DNA, 20 bp, Artificial Sequence
  Description of Artificial Sequence: Synthetic oligonucleotide
  Target: SOD1; (+) strand; PAM type: NRG; PAM sequence: AAG
ttcaccacttaggtacagaa

SEQ ID NO: 11543 - DNA, 20 bp, Artificial Sequence
  Description of Artificial Sequence: Synthetic oligonucleotide
  Target: SOD1; (+) strand; PAM type: NRG; PAM sequence: TGG
acttaggtacagaaaagcat

SEQ ID NO: 11544 - DNA, 20 bp, Artificial Sequence
  Description of Artificial Sequence: Synthetic oligonucleotide
  Target: SOD1; (+) strand; PAM type: NRG; PAM sequence: AAG
atccttttgcaaatataaat

SEQ ID NO: 11545 - DNA, 20 bp, Artificial Sequence
  Description of Artificial Sequence: Synthetic oligonucleotide
  Target: SOD1; (+) strand; PAM type: NRG; PAM sequence: AAG
tactataatactatgattga

SEQ ID NO: 11546 - DNA, 20 bp, Artificial Sequence
  Description of Artificial Sequence: Synthetic oligonucleotide
  Target: SOD1; (+) strand; PAM type: NRG; PAM sequence: AGG
actataatactatgattgaa

SEQ ID NO: 11547 - DNA, 20 bp, Artificial Sequence
  Description of Artificial Sequence: Synthetic oligonucleotide
  Target: SOD1; (+) strand; PAM type: NRG; PAM sequence: GAG
tataatactatgattgaaag

SEQ ID NO: 11548 - DNA, 20 bp, Artificial Sequence
  Description of Artificial Sequence: Synthetic oligonucleotide
  Target: SOD1; (+) strand; PAM type: NRG; PAM sequence: TGG
gaaaggagttattctgataa

SEQ ID NO: 11549 - DNA, 20 bp, Artificial Sequence
  Description of Artificial Sequence: Synthetic oligonucleotide
  Target: SOD1; (+) strand; PAM type: NRG; PAM sequence: CAG
tctgataatggaaaatgttc

SEQ ID NO: 11550 - DNA, 20 bp, Artificial Sequence
  Description of Artificial Sequence: Synthetic oligonucleotide
  Target: SOD1; (+) strand; PAM type: NRG; PAM sequence: AGG
ctgataatggaaaatgttcc

SEQ ID NO: 11551 - DNA, 20 bp, Artificial Sequence
  Description of Artificial Sequence: Synthetic oligonucleotide
  Target: SOD1; (+) strand; PAM type: NRG; PAM sequence: AAG
aaaatgttccaggtactgtt

SEQ ID NO: 11552 - DNA, 20 bp, Artificial Sequence
  Description of Artificial Sequence: Synthetic oligonucleotide
  Target: SOD1; (+) strand; PAM type: NRG; PAM sequence: CAG
tgctatttacccatgtgctg

SEQ ID NO: 11553 - DNA, 20 bp, Artificial Sequence
  Description of Artificial Sequence: Synthetic oligonucleotide
  Target: SOD1; (+) strand; PAM type: NRG; PAM sequence: AAG
atttacccatgtgctgcaga

SEQ ID NO: 11554 - DNA, 20 bp, Artificial Sequence
  Description of Artificial Sequence: Synthetic oligonucleotide
  Target: SOD1; (+) strand; PAM type: NRG; PAM sequence: AGG
tttacccatgtgctgcagaa

SEQ ID NO: 11555 - DNA, 20 bp, Artificial Sequence
  Description of Artificial Sequence: Synthetic oligonucleotide
  Target: SOD1; (+) strand; PAM type: NRG; PAM sequence: GAG
tgtgctgcagaaaggtcttt

SEQ ID NO: 11556 - DNA, 20 bp, Artificial Sequence
  Description of Artificial Sequence: Synthetic oligonucleotide
  Target: SOD1; (+) strand; PAM type: NRG; PAM sequence: AAG
ctgcagaaaggtctttgagc

SEQ ID NO: 11557 - DNA, 20 bp, Artificial Sequence
  Description of Artificial Sequence: Synthetic oligonucleotide
  Target: SOD1; (+) strand; PAM type: NRG; PAM sequence: TGG
aaaggtctttgagcaagtta

SEQ ID NO: 11558 - DNA, 20 bp, Artificial Sequence
  Description of Artificial Sequence: Synthetic oligonucleotide
  Target: SOD1; (+) strand; PAM type: NRG; PAM sequence: GGG
aaggtctttgagcaagttat

SEQ ID NO: 11559 - DNA, 20 bp, Artificial Sequence
  Description of Artificial Sequence: Synthetic oligonucleotide
  Target: SOD1; (+) strand; PAM type: NRG; PAM sequence: CAG
agcaagttatgggttatgat

SEQ ID NO: 11560 - DNA, 20 bp, Artificial Sequence
  Description of Artificial Sequence: Synthetic oligonucleotide
  Target: SOD1; (+) strand; PAM type: NRG; PAM sequence: TAG
agttatgggttatgatcagt

SEQ ID NO: 11561 - DNA, 20 bp, Artificial Sequence
  Description of Artificial Sequence: Synthetic oligonucleotide
  Target: SOD1; (+) strand; PAM type: NRG; PAM sequence: TGG
gggttatgatcagttagcaa

SEQ ID NO: 11562 - DNA, 20 bp, Artificial Sequence
  Description of Artificial Sequence: Synthetic oligonucleotide
  Target: SOD1; (+) strand; PAM type: NRG; PAM sequence: AAG
tatgatcagttagcaatggt

SEQ ID NO: 11563 - DNA, 20 bp, Artificial Sequence
  Description of Artificial Sequence: Synthetic oligonucleotide
  Target: SOD1; (+) strand; PAM type: NRG; PAM sequence: TGG
gcaatggtaagaaaaatact

SEQ ID NO: 11564 - DNA, 20 bp, Artificial Sequence
  Description of Artificial Sequence: Synthetic oligonucleotide
  Target: SOD1; (+) strand; PAM type: NRG; PAM sequence: GGG
caatggtaagaaaaatactt

SEQ ID NO: 11565 - DNA, 20 bp, Artificial Sequence
  Description of Artificial Sequence: Synthetic oligonucleotide
  Target: SOD1; (+) strand; PAM type: NRG; PAM sequence: CAG
aaatacttgggtgacactga

SEQ ID NO: 11566 - DNA, 20 bp, Artificial Sequence
  Description of Artificial Sequence: Synthetic oligonucleotide
  Target: SOD1; (+) strand; PAM type: NRG; PAM sequence: TGG
ctgacagaaaaatgaccaat

SEQ ID NO: 11567 - DNA, 20 bp, Artificial Sequence
  Description of Artificial Sequence: Synthetic oligonucleotide
  Target: SOD1; (+) strand; PAM type: NRG; PAM sequence: GGG
tgacagaaaaatgaccaatt

SEQ ID NO: 11568 - DNA, 20 bp, Artificial Sequence
  Description of Artificial Sequence: Synthetic oligonucleotide
  Target: SOD1; (+) strand; PAM type: NRG; PAM sequence: CAG
ttgggaaatgctgattacca

SEQ ID NO: 11569 - DNA, 20 bp, Artificial Sequence
  Description of Artificial Sequence: Synthetic oligonucleotide
  Target: SOD1; (+) strand; PAM type: NRG; PAM sequence: AAG
aatgctgattaccacagcaa

SEQ ID NO: 11570 - DNA, 20 bp, Artificial Sequence
  Description of Artificial Sequence: Synthetic oligonucleotide
  Target: SOD1; (+) strand; PAM type: NRG; PAM sequence: CAG
gattaccacagcaaaagcgc

SEQ ID NO: 11571 - DNA, 20 bp, Artificial Sequence
  Description of Artificial Sequence: Synthetic oligonucleotide
  Target: SOD1; (+) strand; PAM type: NRG; PAM sequence: TGG
aagcgccagaaattgtgaaa

SEQ ID NO: 11572 - DNA, 20 bp, Artificial Sequence
  Description of Artificial Sequence: Synthetic oligonucleotide
  Target: SOD1; (+) strand; PAM type: NRG; PAM sequence: GAG
ccagaaattgtgaaatggat

SEQ ID NO: 11573 - DNA, 20 bp, Artificial Sequence
  Description of Artificial Sequence: Synthetic oligonucleotide
  Target: SOD1; (+) strand; PAM type: NRG; PAM sequence: AGG
cagaaattgtgaaatggatg

SEQ ID NO: 11574 - DNA, 20 bp, Artificial Sequence
  Description of Artificial Sequence: Synthetic oligonucleotide
  Target: SOD1; (+) strand; PAM type: NRG; PAM sequence: TGG
ttgtgaaatggatgaggtga

SEQ ID NO: 11575 - DNA, 20 bp, Artificial Sequence
  Description of Artificial Sequence: Synthetic oligonucleotide
  Target: SOD1; (+) strand; PAM type: NRG; PAM sequence: CAG
gtgatggctctgtcccttca

SEQ ID NO: 11576 - DNA, 20 bp, Artificial Sequence
  Description of Artificial Sequence: Synthetic oligonucleotide
  Target: SOD1; (+) strand; PAM type: NRG; PAM sequence: AGG
tgatggctctgtcccttcac

SEQ ID NO: 11577 - DNA, 20 bp, Artificial Sequence
  Description of Artificial Sequence: Synthetic oligonucleotide
  Target: SOD1; (+) strand; PAM type: NRG; PAM sequence: CAG
ctgtcccttcacaggctctt

SEQ ID NO: 11578 - DNA, 20 bp, Artificial Sequence
  Description of Artificial Sequence: Synthetic oligonucleotide
  Target: SOD1; (+) strand; PAM type: NRG; PAM sequence: TGG
cacaggctcttcagacactt

SEQ ID NO: 11579 - DNA, 20 bp, Artificial Sequence
  Description of Artificial Sequence: Synthetic oligonucleotide
  Target: SOD1; (+) strand; PAM type: NRG; PAM sequence: GGG
acaggctcttcagacacttt

SEQ ID NO: 11580 - DNA, 20 bp, Artificial Sequence
  Description of Artificial Sequence: Synthetic oligonucleotide
  Target: SOD1; (+) strand; PAM type: NRG; PAM sequence: AAG
ttgggaaaatcccaatgaac

SEQ ID NO: 11581 - DNA, 20 bp, Artificial Sequence
  Description of Artificial Sequence: Synthetic oligonucleotide
  Target: SOD1; (+) strand; PAM type: NRG; PAM sequence: CAG
aaaatcccaatgaacaagta

SEQ ID NO: 11582 - DNA, 20 bp, Artificial Sequence
  Description of Artificial Sequence: Synthetic oligonucleotide
  Target: SOD1; (+) strand; PAM type: NRG; PAM sequence: AGG
aaatcccaatgaacaagtac

SEQ ID NO: 11583 - DNA, 20 bp, Artificial Sequence
  Description of Artificial Sequence: Synthetic oligonucleotide
  Target: SOD1; (+) strand; PAM type: NRG; PAM sequence: CAG
aatgaacaagtacaggacac

SEQ ID NO: 11584 - DNA, 20 bp, Artificial Sequence
  Description of Artificial Sequence: Synthetic oligonucleotide
  Target: SOD1; (+) strand; PAM type: NRG; PAM sequence: CAG
acaccagctacactgtatct

SEQ ID NO: 11585 - DNA, 20 bp, Artificial Sequence
  Description of Artificial Sequence: Synthetic oligonucleotide
  Target: SOD1; (+) strand; PAM type: NRG; PAM sequence: TAG
cagctacactgtatctcaga

SEQ ID NO: 11586 - DNA, 20 bp, Artificial Sequence
  Description of Artificial Sequence: Synthetic oligonucleotide
  Target: SOD1; (+) strand; PAM type: NRG; PAM sequence: TGG
aaaacactcttcacatcatt

SEQ ID NO: 11587 - DNA, 20 bp, Artificial Sequence
  Description of Artificial Sequence: Synthetic oligonucleotide
  Target: SOD1; (+) strand; PAM type: NRG; PAM sequence: GGG
aaacactcttcacatcattt

SEQ ID NO: 11588 - DNA, 20 bp, Artificial Sequence
  Description of Artificial Sequence: Synthetic oligonucleotide
  Target: SOD1; (+) strand; PAM type: NRG; PAM sequence: GAG
tcatttgggaaatatttacc

SEQ ID NO: 11589 - DNA, 20 bp, Artificial Sequence
  Description of Artificial Sequence: Synthetic oligonucleotide
  Target: SOD1; (+) strand; PAM type: NRG; PAM sequence: TGG
accgagtatataccatacac

SEQ ID NO: 11590 - DNA, 20 bp, Artificial Sequence
  Description of Artificial Sequence: Synthetic oligonucleotide
  Target: SOD1; (+) strand; PAM type: NRG; PAM sequence: GGG
ccgagtatataccatacact

SEQ ID NO: 11591 - DNA, 20 bp, Artificial Sequence
  Description of Artificial Sequence: Synthetic oligonucleotide
  Target: SOD1; (+) strand; PAM type: NRG; PAM sequence: GGG
cgagtatataccatacactg

SEQ ID NO: 11592 - DNA, 20 bp, Artificial Sequence
  Description of Artificial Sequence: Synthetic oligonucleotide
  Target: SOD1; (+) strand; PAM type: NRG; PAM sequence: CAG
tataccatacactggggcaa

SEQ ID NO: 11593 - DNA, 20 bp, Artificial Sequence
  Description of Artificial Sequence: Synthetic oligonucleotide
  Target: SOD1; (+) strand; PAM type: NRG; PAM sequence: AAG
accatacactggggcaacag

SEQ ID NO: 11594 - DNA, 20 bp, Artificial Sequence
  Description of Artificial Sequence: Synthetic oligonucleotide
  Target: SOD1; (+) strand; PAM type: NRG; PAM sequence: AAG
gtccttgctttcactttgta

SEQ ID NO: 11595 - DNA, 20 bp, Artificial Sequence
  Description of Artificial Sequence: Synthetic oligonucleotide
  Target: SOD1; (+) strand; PAM type: NRG; PAM sequence: TAG
gctttcactttgtaaagaaa

SEQ ID NO: 11596 - DNA, 20 bp, Artificial Sequence
  Description of Artificial Sequence: Synthetic oligonucleotide
  Target: SOD1; (+) strand; PAM type: NRG; PAM sequence: TAG
cactttgtaaagaaatagtg

SEQ ID NO: 11597 - DNA, 20 bp, Artificial Sequence
  Description of Artificial Sequence: Synthetic oligonucleotide
  Target: SOD1; (+) strand; PAM type: NRG; PAM sequence: TGG
tagtgtagttccaacacctg

SEQ ID NO: 11598 - DNA, 20 bp, Artificial Sequence
  Description of Artificial Sequence: Synthetic oligonucleotide
  Target: SOD1; (+) strand; PAM type: NRG; PAM sequence: CAG
aaacataaaatgtatatgcc

SEQ ID NO: 11599 - DNA, 20 bp, Artificial Sequence
  Description of Artificial Sequence: Synthetic oligonucleotide
  Target: SOD1; (+) strand; PAM type: NRG; PAM sequence: AGG
aacataaaatgtatatgccc

SEQ ID NO: 11600 - DNA, 20 bp, Artificial Sequence
  Description of Artificial Sequence: Synthetic oligonucleotide
  Target: SOD1; (+) strand; PAM type: NRG; PAM sequence: CAG
aaaatgtatatgcccaggca

SEQ ID NO: 11601 - DNA, 20 bp, Artificial Sequence
  Description of Artificial Sequence: Synthetic oligonucleotide
  Target: SOD1; (+) strand; PAM type: NRG; PAM sequence: TAG
ccaggcacagtctcttttaa

SEQ ID NO: 11602 - DNA, 20 bp, Artificial Sequence
  Description of Artificial Sequence: Synthetic oligonucleotide
  Target: SOD1; (+) strand; PAM type: NRG; PAM sequence: GAG
aggcacagtctcttttaata

SEQ ID NO: 11603 - DNA, 20 bp, Artificial Sequence
  Description of Artificial Sequence: Synthetic oligonucleotide
  Target: SOD1; (+) strand; PAM type: NRG; PAM sequence: AGG
ggcacagtctcttttaatag

SEQ ID NO: 11604 - DNA, 20 bp, Artificial Sequence
  Description of Artificial Sequence: Synthetic oligonucleotide
  Target: SOD1; (+) strand; PAM type: NRG; PAM sequence: GGG
gcacagtctcttttaataga

SEQ ID NO: 11605 - DNA, 20 bp, Artificial Sequence
  Description of Artificial Sequence: Synthetic oligonucleotide
  Target: SOD1; (+) strand; PAM type: NRG; PAM sequence: TAG
ttaatagagggatcattata

SEQ ID NO: 11606 - DNA, 20 bp, Artificial Sequence
  Description of Artificial Sequence: Synthetic oligonucleotide
  Target: SOD1; (+) strand; PAM type: NRG; PAM sequence: CAG
actttcccattaccttttat

SEQ ID NO: 11607 - DNA, 20 bp, Artificial Sequence
  Description of Artificial Sequence: Synthetic oligonucleotide
  Target: SOD1; (+) strand; PAM type: NRG; PAM sequence: AAG
cccattaccttttatcagta

SEQ ID NO: 11608 - DNA, 20 bp, Artificial Sequence
  Description of Artificial Sequence: Synthetic oligonucleotide
  Target: SOD1; (+) strand; PAM type: NRG; PAM sequence: CAG
atcagtaaagatttgttttc

SEQ ID NO: 11609 - DNA, 20 bp, Artificial Sequence
  Description of Artificial Sequence: Synthetic oligonucleotide
  Target: SOD1; (+) strand; PAM type: NRG; PAM sequence: AGG
tcagtaaagatttgttttcc

SEQ ID NO: 11610 - DNA, 20 bp, Artificial Sequence
  Description of Artificial Sequence: Synthetic oligonucleotide
  Target: SOD1; (+) strand; PAM type: NRG; PAM sequence: CGG
tgaccaatgtttactgttaa

SEQ ID NO: 11611 - DNA, 20 bp, Artificial Sequence
  Description of Artificial Sequence: Synthetic oligonucleotide
  Target: SOD1; (+) strand; PAM type: NRG; PAM sequence: GAG
accaatgtttactgttaacg

SEQ ID NO: 11612 - DNA, 20 bp, Artificial Sequence
  Description of Artificial Sequence: Synthetic oligonucleotide
  Target: SOD1; (+) strand; PAM type: NRG; PAM sequence: AGG
ccaatgtttactgttaacgg

SEQ ID NO: 11613 - DNA, 20 bp, Artificial Sequence
  Description of Artificial Sequence: Synthetic oligonucleotide
  Target: SOD1; (+) strand; PAM type: NRG; PAM sequence: CAG
tgtttactgttaacggaggt

SEQ ID NO: 11614 - DNA, 20 bp, Artificial Sequence
  Description of Artificial Sequence: Synthetic oligonucleotide
  Target: SOD1; (+) strand; PAM type: NRG; PAM sequence: TAG
actgttaacggaggtcagca

SEQ ID NO: 11615 - DNA, 20 bp, Artificial Sequence
  Description of Artificial Sequence: Synthetic oligonucleotide
  Target: SOD1; (+) strand; PAM type: NRG; PAM sequence: TGG
gaggtcagcatagaacattc

SEQ ID NO: 11616 - DNA, 20 bp, Artificial Sequence
  Description of Artificial Sequence: Synthetic oligonucleotide
  Target: SOD1; (-) strand; PAM type: YTN; PAM sequence: CTC
aggagcccagctggcgtcac

SEQ ID NO: 11617 - DNA, 20 bp, Artificial Sequence
  Description of Artificial Sequence: Synthetic oligonucleotide
  Target: SOD1; (-) strand; PAM type: YTN; PAM sequence: CTA
aactcaggagcccagctggc

SEQ ID NO: 11618 - DNA, 20 bp, Artificial Sequence
  Description of Artificial Sequence: Synthetic oligonucleotide
  Target: SOD1; (-) strand; PAM type: YTN; PAM sequence: CTG
caggtccccactaaactcag

SEQ ID NO: 11619 - DNA, 20 bp, Artificial Sequence
  Description of Artificial Sequence: Synthetic oligonucleotide
  Target: SOD1; (-) strand; PAM type: YTN; PAM sequence: TTC
tgcaggtccccactaaactc

SEQ ID NO: 11620 - DNA, 20 bp, Artificial Sequence
  Description of Artificial Sequence: Synthetic oligonucleotide
  Target: SOD1; (-) strand; PAM type: YTN; PAM sequence: CTA
gacataaaggttctgcaggt

SEQ ID NO: 11621 - DNA, 20 bp, Artificial Sequence
  Description of Artificial Sequence: Synthetic oligonucleotide
  Target: SOD1; (-) strand; PAM type: YTN; PAM sequence: TTA
gctagacataaaggttctgc

SEQ ID NO: 11622 - DNA, 20 bp, Artificial Sequence
  Description of Artificial Sequence: Synthetic oligonucleotide
  Target: SOD1; (-) strand; PAM type: YTN; PAM sequence: CTT
agctagacataaaggttctg

SEQ ID NO: 11623 - DNA, 20 bp, Artificial Sequence
  Description of Artificial Sequence: Synthetic oligonucleotide
  Target: SOD1; (-) strand; PAM type: YTN; PAM sequence: TTA
caatcccttagctagacata

SEQ ID NO: 11624 - DNA, 20 bp, Artificial Sequence
  Description of Artificial Sequence: Synthetic oligonucleotide
  Target: SOD1; (-) strand; PAM type: YTN; PAM sequence: TTT
acaatcccttagctagacat

SEQ ID NO: 11625 - DNA, 20 bp, Artificial Sequence
  Description of Artificial Sequence: Synthetic oligonucleotide
  Target: SOD1; (-) strand; PAM type: YTN; PAM sequence: TTG
gtgcatttacaatcccttag

SEQ ID NO: 11626 - DNA, 20 bp, Artificial Sequence
  Description of Artificial Sequence: Synthetic oligonucleotide
  Target: SOD1; (-) strand; PAM type: YTN; PAM sequence: CTA
gacacagggtgccgattggt

SEQ ID NO: 11627 - DNA, 20 bp, Artificial Sequence
  Description of Artificial Sequence: Synthetic oligonucleotide
  Target: SOD1; (-) strand; PAM type: YTN; PAM sequence: CTG
agctagacacagggtgccga

SEQ ID NO: 11628 - DNA, 20 bp, Artificial Sequence
  Description of Artificial Sequence: Synthetic oligonucleotide
  Target: SOD1; (-) strand; PAM type: YTN; PAM sequence: TTC
acaaaccctgagctagacac

SEQ ID NO: 11629 - DNA, 20 bp, Artificial Sequence
  Description of Artificial Sequence: Synthetic oligonucleotide
  Target: SOD1; (-) strand; PAM type: YTN; PAM sequence: TTC
gtgcattcacaaaccctgag

SEQ ID NO: 11630 - DNA, 20 bp, Artificial Sequence
  Description of Artificial Sequence: Synthetic oligonucleotide
  Target: SOD1; (-) strand; PAM type: YTN; PAM sequence: CTA
gatacagagtgtcgattcgt

SEQ ID NO: 11631 - DNA, 20 bp, Artificial Sequence
  Description of Artificial Sequence: Synthetic oligonucleotide
  Target: SOD1; (-) strand; PAM type: YTN; PAM sequence: CTC
cccaccagagtagctagata

SEQ ID NO: 11632 - DNA, 20 bp, Artificial Sequence
  Description of Artificial Sequence: Synthetic oligonucleotide
  Target: SOD1; (-) strand; PAM type: YTN; PAM sequence: CTC
cacctccccaccagagtagc

SEQ ID NO: 11633 - DNA, 20 bp, Artificial Sequence
  Description of Artificial Sequence: Synthetic oligonucleotide
  Target: SOD1; (-) strand; PAM type: YTN; PAM sequence: TTC
tccacctccccaccagagta

SEQ ID NO: 11634 - DNA, 20 bp, Artificial Sequence
  Description of Artificial Sequence: Synthetic oligonucleotide
  Target: SOD1; (-) strand; PAM type: YTN; PAM sequence: CTA
gacacaaaggttctccacct

SEQ ID NO: 11635 - DNA, 20 bp, Artificial Sequence
  Description of Artificial Sequence: Synthetic oligonucleotide
  Target: SOD1; (-) strand; PAM type: YTN; PAM sequence: CTG
agctagacacaaaggttctc

SEQ ID NO: 11636 - DNA, 20 bp, Artificial Sequence
  Description of Artificial Sequence: Synthetic oligonucleotide
  Target: SOD1; (-) strand; PAM type: YTN; PAM sequence: TTA
caatccctgagctagacaca

SEQ ID NO: 11637 - DNA, 20 bp, Artificial Sequence
  Description of Artificial Sequence: Synthetic oligonucleotide
  Target: SOD1; (-) strand; PAM type: YTN; PAM sequence: TTT
acaatccctgagctagacac

SEQ ID NO: 11638 - DNA, 20 bp, Artificial Sequence
  Description of Artificial Sequence: Synthetic oligonucleotide
  Target: SOD1; (-) strand; PAM type: YTN; PAM sequence: TTG
gtgtgtttacaatccctgag

SEQ ID NO: 11639 - DNA, 20 bp, Artificial Sequence
  Description of Artificial Sequence: Synthetic oligonucleotide
  Target: SOD1; (-) strand; PAM type: YTN; PAM sequence: CTG
attggtgtgtttacaatccc

SEQ ID NO: 11640 - DNA, 20 bp, Artificial Sequence
  Description of Artificial Sequence: Synthetic oligonucleotide
  Target: SOD1; (-) strand; PAM type: YTN; PAM sequence: TTG
acagggcgctgattggtgtg

SEQ ID NO: 11641 - DNA, 20 bp, Artificial Sequence
  Description of Artificial Sequence: Synthetic oligonucleotide
  Target: SOD1; (-) strand; PAM type: YTN; PAM sequence: TTT
gacagggcgctgattggtgt

SEQ ID NO: 11642 - DNA, 20 bp, Artificial Sequence
  Description of Artificial Sequence: Synthetic oligonucleotide
  Target: SOD1; (-) strand; PAM type: YTN; PAM sequence: TTT
tgacagggcgctgattggtg

SEQ ID NO: 11643 - DNA, 20 bp, Artificial Sequence
  Description of Artificial Sequence: Synthetic oligonucleotide
  Target: SOD1; (-) strand; PAM type: YTN; PAM sequence: CTG
ttttgacagggcgctgattg

SEQ ID NO: 11644 - DNA, 20 bp, Artificial Sequence
  Description of Artificial Sequence: Synthetic oligonucleotide
  Target: SOD1; (-) strand; PAM type: YTN; PAM sequence: TTG
gtagagccgagtggtctgtt

SEQ ID NO: 11645 - DNA, 20 bp, Artificial Sequence
  Description of Artificial Sequence: Synthetic oligonucleotide
  Target: SOD1; (-) strand; PAM type: YTN; PAM sequence: CTG
attggtagagccgagtggtc

SEQ ID NO: 11646 - DNA, 20 bp, Artificial Sequence
  Description of Artificial Sequence: Synthetic oligonucleotide
  Target: SOD1; (-) strand; PAM type: YTN; PAM sequence: CTG
ctgattggtagagccgagtg

SEQ ID NO: 11647 - DNA, 20 bp, Artificial Sequence
  Description of Artificial Sequence: Synthetic oligonucleotide
  Target: SOD1; (-) strand; PAM type: YTN; PAM sequence: CTG
gccccacccacatcctgctg

SEQ ID NO: 11648 - DNA, 20 bp, Artificial Sequence
  Description of Artificial Sequence: Synthetic oligonucleotide
  Target: SOD1; (-) strand; PAM type: YTN; PAM sequence: TTA
tctggccccacccacatcct

SEQ ID NO: 11649 - DNA, 20 bp, Artificial Sequence
  Description of Artificial Sequence: Synthetic oligonucleotide
  Target: SOD1; (-) strand; PAM type: YTN; PAM sequence: TTT
atctggccccacccacatcc

SEQ ID NO: 11650 - DNA, 20 bp, Artificial Sequence
  Description of Artificial Sequence: Synthetic oligonucleotide
  Target: SOD1; (-) strand; PAM type: YTN; PAM sequence: TTT
tatctggccccacccacatc

SEQ ID NO: 11651 - DNA, 20 bp, Artificial Sequence
  Description of Artificial Sequence: Synthetic oligonucleotide
  Target: SOD1; (-) strand; PAM type: YTN; PAM sequence: CTT
ttatctggccccacccacat

SEQ ID NO: 11652 - DNA, 20 bp, Artificial Sequence
  Description of Artificial Sequence: Synthetic oligonucleotide
  Target: SOD1; (-) strand; PAM type: YTN; PAM sequence: TTC
ttttatctggccccacccac

SEQ ID NO: 11653 - DNA, 20 bp, Artificial Sequence
  Description of Artificial Sequence: Synthetic oligonucleotide
  Target: SOD1; (-) strand; PAM type: YTN; PAM sequence: TTA
ttcttttatctggccccacc

SEQ ID NO: 11654 - DNA, 20 bp, Artificial Sequence
  Description of Artificial Sequence: Synthetic oligonucleotide
  Target: SOD1; (-) strand; PAM type: YTN; PAM sequence: TTT
attcttttatctggccccac

SEQ ID NO: 11655 - DNA, 20 bp, Artificial Sequence
  Description of Artificial Sequence: Synthetic oligonucleotide
  Target: SOD1; (-) strand; PAM type: YTN; PAM sequence: TTT
tattcttttatctggcccca

SEQ ID NO: 11656 - DNA, 20 bp, Artificial Sequence
  Description of Artificial Sequence: Synthetic oligonucleotide
  Target: SOD1; (-) strand; PAM type: YTN; PAM sequence: CTT
ttattcttttatctggcccc

SEQ ID NO: 11657 - DNA, 20 bp, Artificial Sequence
  Description of Artificial Sequence: Synthetic oligonucleotide
  Target: SOD1; (-) strand; PAM type: YTN; PAM sequence: CTG
cttttattcttttatctggc

SEQ ID NO: 11658 - DNA, 20 bp, Artificial Sequence
  Description of Artificial Sequence: Synthetic oligonucleotide
  Target: SOD1; (-) strand; PAM type: YTN; PAM sequence: CTC
aggcagcctgcttttattct

SEQ ID NO: 11659 - DNA, 20 bp, Artificial Sequence
  Description of Artificial Sequence: Synthetic oligonucleotide
  Target: SOD1; (-) strand; PAM type: YTN; PAM sequence: CTG
gctcaggcagcctgctttta

SEQ ID NO: 11660 - DNA, 20 bp, Artificial Sequence
  Description of Artificial Sequence: Synthetic oligonucleotide
  Target: SOD1; (-) strand; PAM type: YTN; PAM sequence: CTG
ctggctcaggcagcctgctt

SEQ ID NO: 11661 - DNA, 20 bp, Artificial Sequence
  Description of Artificial Sequence: Synthetic oligonucleotide
  Target: SOD1; (-) strand; PAM type: YTN; PAM sequence: TTG
ccactgctggctcaggcagc

SEQ ID NO: 11662 - DNA, 20 bp, Artificial Sequence
  Description of Artificial Sequence: Synthetic oligonucleotide
  Target: SOD1; (-) strand; PAM type: YTN; PAM sequence: CTT
gccactgctggctcaggcag

SEQ ID NO: 11663 - DNA, 20 bp, Artificial Sequence
  Description of Artificial Sequence: Synthetic oligonucleotide
  Target: SOD1; (-) strand; PAM type: YTN; PAM sequence: TTC
cacagtatggaaggggaccc

SEQ ID NO: 11664 - DNA, 20 bp, Artificial Sequence
  Description of Artificial Sequence: Synthetic oligonucleotide
  Target: SOD1; (-) strand; PAM type: YTN; PAM sequence: CTT
ccacagtatggaaggggacc

SEQ ID NO: 11665 - DNA, 20 bp, Artificial Sequence
  Description of Artificial Sequence: Synthetic oligonucleotide
  Target: SOD1; (-) strand; PAM type: YTN; PAM sequence: TTG
caaagaaagacaaagcttcc

SEQ ID NO: 11666 - DNA, 20 bp, Artificial Sequence
  Description of Artificial Sequence: Synthetic oligonucleotide
  Target: SOD1; (-) strand; PAM type: YTN; PAM sequence: TTA
ttgcaaagaaagacaaagct

SEQ ID NO: 11667 - DNA, 20 bp, Artificial Sequence
  Description of Artificial Sequence: Synthetic oligonucleotide
  Target: SOD1; (-) strand; PAM type: YTN; PAM sequence: TTT
attgcaaagaaagacaaagc

SEQ ID NO: 11668 - DNA, 20 bp, Artificial Sequence
  Description of Artificial Sequence: Synthetic oligonucleotide
  Target: SOD1; (-) strand; PAM type: YTN; PAM sequence: CTC
ataaaggcagtgtggaccca

SEQ ID NO: 11669 - DNA, 20 bp, Artificial Sequence
  Description of Artificial Sequence: Synthetic oligonucleotide
  Target: SOD1; (-) strand; PAM type: YTN; PAM sequence: TTA
cagctcataaaggcagtgtg

SEQ ID NO: 11670 - DNA, 20 bp, Artificial Sequence
  Description of Artificial Sequence: Synthetic oligonucleotide
  Target: SOD1; (-) strand; PAM type: YTN; PAM sequence: TTC
gtggtgagtgttacagctca

SEQ ID NO: 11671 - DNA, 20 bp, Artificial Sequence
  Description of Artificial Sequence: Synthetic oligonucleotide
  Target: SOD1; (-) strand; PAM type: YTN; PAM sequence: CTT
cgtggtgagtgttacagctc

SEQ ID NO: 11672 - DNA, 20 bp, Artificial Sequence
  Description of Artificial Sequence: Synthetic oligonucleotide
  Target: SOD1; (-) strand; PAM type: YTN; PAM sequence: CTG
cagaccttcgtggtgagtgt

SEQ ID NO: 11673 - DNA, 20 bp, Artificial Sequence
  Description of Artificial Sequence: Synthetic oligonucleotide
  Target: SOD1; (-) strand; PAM type: YTN; PAM sequence: TTC
agcagtgaagctgcagacct

SEQ ID NO: 11674 - DNA, 20 bp, Artificial Sequence
  Description of Artificial Sequence: Synthetic oligonucleotide
  Target: SOD1; (-) strand; PAM type: YTN; PAM sequence: CTT
cagcagtgaagctgcagacc

SEQ ID NO: 11675 - DNA, 20 bp, Artificial Sequence
  Description of Artificial Sequence: Synthetic oligonucleotide
  Target: SOD1; (-) strand; PAM type: YTN; PAM sequence: TTG
gcttcagcagtgaagctgca

SEQ ID NO: 11676 - DNA, 20 bp, Artificial Sequence
  Description of Artificial Sequence: Synthetic oligonucleotide
  Target: SOD1; (-) strand; PAM type: YTN; PAM sequence: CTC
attggcttcagcagtgaagc

SEQ ID NO: 11677 - DNA, 20 bp, Artificial Sequence
  Description of Artificial Sequence: Synthetic oligonucleotide
  Target: SOD1; (-) strand; PAM type: YTN; PAM sequence: TTC
gtggtctcattggcttcagc

SEQ ID NO: 11678 - DNA, 20 bp, Artificial Sequence
  Description of Artificial Sequence: Synthetic oligonucleotide
  Target: SOD1; (-) strand; PAM type: YTN; PAM sequence: CTC
ccggggggttcgtggtctca

SEQ ID NO: 11679 - DNA, 20 bp, Artificial Sequence
  Description of Artificial Sequence: Synthetic oligonucleotide
  Target: SOD1; (-) strand; PAM type: YTN; PAM sequence: TTC
ctcccggggggttcgtggtc

SEQ ID NO: 11680 - DNA, 20 bp, Artificial Sequence
  Description of Artificial Sequence: Synthetic oligonucleotide
  Target: SOD1; (-) strand; PAM type: YTN; PAM sequence: TTC
attcctcccggggggttcgt

SEQ ID NO: 11681 - DNA, 20 bp, Artificial Sequence
  Description of Artificial Sequence: Synthetic oligonucleotide
  Target: SOD1; (-) strand; PAM type: YTN; PAM sequence: TTG
ttcattcctcccggggggtt

SEQ ID NO: 11682 - DNA, 20 bp, Artificial Sequence
  Description of Artificial Sequence: Synthetic oligonucleotide
  Target: SOD1; (-) strand; PAM type: YTN; PAM sequence: CTC
aagttgttcattcctcccgg

SEQ ID NO: 11683 - DNA, 20 bp, Artificial Sequence
  Description of Artificial Sequence: Synthetic oligonucleotide
  Target: SOD1; (-) strand; PAM type: YTN; PAM sequence: TTA
aggcagcgcgtctcaagttg

SEQ ID NO: 11684 - DNA, 20 bp, Artificial Sequence
  Description of Artificial Sequence: Synthetic oligonucleotide
  Target: SOD1; (-) strand; PAM type: YTN; PAM sequence: CTT
aaggcagcgcgtctcaagtt

SEQ ID NO: 11685 - DNA, 20 bp, Artificial Sequence
  Description of Artificial Sequence: Synthetic oligonucleotide
  Target: SOD1; (-) strand; PAM type: YTN; PAM sequence: CTC
ttaaggcagcgcgtctcaag

SEQ ID NO: 11686 - DNA, 20 bp, Artificial Sequence
  Description of Artificial Sequence: Synthetic oligonucleotide
  Target: SOD1; (-) strand; PAM type: YTN; PAM sequence: TTA
cagctcttaaggcagcgcgt

SEQ ID NO: 11687 - DNA, 20 bp, Artificial Sequence
  Description of Artificial Sequence: Synthetic oligonucleotide
  Target: SOD1; (-) strand; PAM type: YTN; PAM sequence: TTC
gcggtgagtgttacagctct

SEQ ID NO: 11688 - DNA, 20 bp, Artificial Sequence
  Description of Artificial Sequence: Synthetic oligonucleotide
  Target: SOD1; (-) strand; PAM type: YTN; PAM sequence: CTT
cgcggtgagtgttacagctc

SEQ ID NO: 11689 - DNA, 20 bp, Artificial Sequence
  Description of Artificial Sequence: Synthetic oligonucleotide
  Target: SOD1; (-) strand; PAM type: YTN; PAM sequence: CTG
cagaccttcgcggtgagtgt

SEQ ID NO: 11690 - DNA, 20 bp, Artificial Sequence
  Description of Artificial Sequence: Synthetic oligonucleotide
  Target: SOD1; (-) strand; PAM type: YTN; PAM sequence: CTC
aggagtgaagctgcagacct

SEQ ID NO: 11691 - DNA, 20 bp, Artificial Sequence
  Description of Artificial Sequence: Synthetic oligonucleotide
  Target: SOD1; (-) strand; PAM type: YTN; PAM sequence: CTG
gctcaggagtgaagctgcag

SEQ ID NO: 11692 - DNA, 20 bp, Artificial Sequence
  Description of Artificial Sequence: Synthetic oligonucleotide
  Target: SOD1; (-) strand; PAM type: YTN; PAM sequence: CTC
gctggctcaggagtgaagct

SEQ ID NO: 11693 - DNA, 20 bp, Artificial Sequence
  Description of Artificial Sequence: Synthetic oligonucleotide
  Target: SOD1; (-) strand; PAM type: YTN; PAM sequence: TTG
tggtctcgctggctcaggag

SEQ ID NO: 11694 - DNA, 20 bp, Artificial Sequence
  Description of Artificial Sequence: Synthetic oligonucleotide
  Target: SOD1; (-) strand; PAM type: YTN; PAM sequence: TTT
gtggtctcgctggctcagga

SEQ ID NO: 11695 - DNA, 20 bp, Artificial Sequence
  Description of Artificial Sequence: Synthetic oligonucleotide
  Target: SOD1; (-) strand; PAM type: YTN; PAM sequence: CTG
gtgggtttgtggtctcgctg

SEQ ID NO: 11696 - DNA, 20 bp, Artificial Sequence
  Description of Artificial Sequence: Synthetic oligonucleotide
  Target: SOD1; (-) strand; PAM type: YTN; PAM sequence: TTC
tggtgggtttgtggtctcgc

SEQ ID NO: 11697 - DNA, 20 bp, Artificial Sequence
  Description of Artificial Sequence: Synthetic oligonucleotide
  Target: SOD1; (-) strand; PAM type: YTN; PAM sequence: CTT
ctggtgggtttgtggtctcg

SEQ ID NO: 11698 - DNA, 20 bp, Artificial Sequence
  Description of Artificial Sequence: Synthetic oligonucleotide
  Target: SOD1; (-) strand; PAM type: YTN; PAM sequence: TTC
cttctggtgggtttgtggtc

SEQ ID NO: 11699 - DNA, 20 bp, Artificial Sequence
  Description of Artificial Sequence: Synthetic oligonucleotide
  Target: SOD1; (-) strand; PAM type: YTN; PAM sequence: CTT
ccttctggtgggtttgtggt

SEQ ID NO: 11700 - DNA, 20 bp, Artificial Sequence
  Description of Artificial Sequence: Synthetic oligonucleotide
  Target: SOD1; (-) strand; PAM type: YTN; PAM sequence: TTC
ttccttctggtgggtttgtg

SEQ ID NO: 11701 - DNA, 20 bp, Artificial Sequence
  Description of Artificial Sequence: Synthetic oligonucleotide
  Target: SOD1; (-) strand; PAM type: YTN; PAM sequence: TTT
cttccttctggtgggtttgt

SEQ ID NO: 11702 - DNA, 20 bp, Artificial Sequence
  Description of Artificial Sequence: Synthetic oligonucleotide
  Target: SOD1; (-) strand; PAM type: YTN; PAM sequence: TTC
ggagtttcttccttctggtg

SEQ ID NO: 11703 - DNA, 20 bp, Artificial Sequence
  Description of Artificial Sequence: Synthetic oligonucleotide
  Target: SOD1; (-) strand; PAM type: YTN; PAM sequence: TTC
agatgtgttcggagtttctt

SEQ ID NO: 11704 - DNA, 20 bp, Artificial Sequence
  Description of Artificial Sequence: Synthetic oligonucleotide
  Target: SOD1; (-) strand; PAM type: YTN; PAM sequence: CTG
atgttcagatgtgttcggag

SEQ ID NO: 11705 - DNA, 20 bp, Artificial Sequence
  Description of Artificial Sequence: Synthetic oligonucleotide
  Target: SOD1; (-) strand; PAM type: YTN; PAM sequence: TTC
tgatgttcagatgtgttcgg

SEQ ID NO: 11706 - DNA, 20 bp, Artificial Sequence
  Description of Artificial Sequence: Synthetic oligonucleotide
  Target: SOD1; (-) strand; PAM type: YTN; PAM sequence: CTT
ctgatgttcagatgtgttcg

SEQ ID NO: 11707 - DNA, 20 bp, Artificial Sequence
  Description of Artificial Sequence: Synthetic oligonucleotide
  Target: SOD1; (-) strand; PAM type: YTN; PAM sequence: TTC
cttctgatgttcagatgtgt

SEQ ID NO: 11708 - DNA, 20 bp, Artificial Sequence
  Description of Artificial Sequence: Synthetic oligonucleotide
  Target: SOD1; (-) strand; PAM type: YTN; PAM sequence: TTG
ttccttctgatgttcagatg

SEQ ID NO: 11709 - DNA, 20 bp, Artificial Sequence
  Description of Artificial Sequence: Synthetic oligonucleotide
  Target: SOD1; (-) strand; PAM type: YTN; PAM sequence: TTT
gttccttctgatgttcagat

SEQ ID NO: 11710 - DNA, 20 bp, Artificial Sequence
  Description of Artificial Sequence: Synthetic oligonucleotide
  Target: SOD1; (-) strand; PAM type: YTN; PAM sequence: TTA
aaggtggcgtgtccggagtt

SEQ ID NO: 11711 - DNA, 20 bp, Artificial Sequence
  Description of Artificial Sequence: Synthetic oligonucleotide
  Target: SOD1; (-) strand; PAM type: YTN; PAM sequence: CTT
aaaggtggcgtgtccggagt

SEQ ID NO: 11712 - DNA, 20 bp, Artificial Sequence
  Description of Artificial Sequence: Synthetic oligonucleotide
  Target: SOD1; (-) strand; PAM type: YTN; PAM sequence: TTC
ttaaaggtggcgtgtccgga

SEQ ID NO: 11713 - DNA, 20 bp, Artificial Sequence
  Description of Artificial Sequence: Synthetic oligonucleotide
  Target: SOD1; (-) strand; PAM type: YTN; PAM sequence: TTA
cagttcttaaaggtggcgtg

SEQ ID NO: 11714 - DNA, 20 bp, Artificial Sequence
  Description of Artificial Sequence: Synthetic oligonucleotide
  Target: SOD1; (-) strand; PAM type: YTN; PAM sequence: CTC
gcggtgagtgttacagttct

SEQ ID NO: 11715 - DNA, 20 bp, Artificial Sequence
  Description of Artificial Sequence: Synthetic oligonucleotide
  Target: SOD1; (-) strand; PAM type: YTN; PAM sequence: TTC
aagaatgaagccgtggaccc

SEQ ID NO: 11716 - DNA, 20 bp, Artificial Sequence
  Description of Artificial Sequence: Synthetic oligonucleotide
  Target: SOD1; (-) strand; PAM type: YTN; PAM sequence: CTT
caagaatgaagccgtggacc

SEQ ID NO: 11717 - DNA, 20 bp, Artificial Sequence
  Description of Artificial Sequence: Synthetic oligonucleotide
  Target: SOD1; (-) strand; PAM type: YTN; PAM sequence: CTG
acttcaagaatgaagccgtg

SEQ ID NO: 11718 - DNA, 20 bp, Artificial Sequence
  Description of Artificial Sequence: Synthetic oligonucleotide
  Target: SOD1; (-) strand; PAM type: YTN; PAM sequence: CTC
actgacttcaagaatgaagc

SEQ ID NO: 11719 - DNA, 20 bp, Artificial Sequence
  Description of Artificial Sequence: Synthetic oligonucleotide
  Target: SOD1; (-) strand; PAM type: YTN; PAM sequence: TTG
gtctcactgacttcaagaat

SEQ ID NO: 11720 - DNA, 20 bp, Artificial Sequence
  Description of Artificial Sequence: Synthetic oligonucleotide
  Target: SOD1; (-) strand; PAM type: YTN; PAM sequence: CTT
ggtctcactgacttcaagaa

SEQ ID NO: 11721 - DNA, 20 bp, Artificial Sequence
  Description of Artificial Sequence: Synthetic oligonucleotide
  Target: SOD1; (-) strand; PAM type: YTN; PAM sequence: TTC
ttggtctcactgacttcaag

SEQ ID NO: 11722 - DNA, 20 bp, Artificial Sequence
  Description of Artificial Sequence: Synthetic oligonucleotide
  Target: SOD1; (-) strand; PAM type: YTN; PAM sequence: TTG
gtgggttcttggtctcactg

SEQ ID NO: 11723 - DNA, 20 bp, Artificial Sequence
  Description of Artificial Sequence: Synthetic oligonucleotide
  Target: SOD1; (-) strand; PAM type: YTN; PAM sequence: CTG
gtgtgtccggaattggtggg

SEQ ID NO: 11724 - DNA, 20 bp, Artificial Sequence
  Description of Artificial Sequence: Synthetic oligonucleotide
  Target: SOD1; (-) strand; PAM type: YTN; PAM sequence: CTA
gtagctggtgtgtccggaat

SEQ ID NO: 11725 - DNA, 20 bp, Artificial Sequence
  Description of Artificial Sequence: Synthetic oligonucleotide
  Target: SOD1; (-) strand; PAM type: YTN; PAM sequence: CTC
cctagtagctggtgtgtccg

SEQ ID NO: 11726 - DNA, 20 bp, Artificial Sequence
  Description of Artificial Sequence: Synthetic oligonucleotide
  Target: SOD1; (-) strand; PAM type: YTN; PAM sequence: CTC
agcctccctagtagctggtg

SEQ ID NO: 11727 - DNA, 20 bp, Artificial Sequence
  Description of Artificial Sequence: Synthetic oligonucleotide
  Target: SOD1; (-) strand; PAM type: YTN; PAM sequence: CTC
acctcagcctccctagtagc

SEQ ID NO: 11728 - DNA, 20 bp, Artificial Sequence
  Description of Artificial Sequence: Synthetic oligonucleotide
  Target: SOD1; (-) strand; PAM type: YTN; PAM sequence: TTC
aggtgatcccctcacctcag

SEQ ID NO: 11729 - DNA, 20 bp, Artificial Sequence
  Description of Artificial Sequence: Synthetic oligonucleotide
  Target: SOD1; (-) strand; PAM type: YTN; PAM sequence: CTG
gattcaggtgatcccctcac

SEQ ID NO: 11730 - DNA, 20 bp, Artificial Sequence
  Description of Artificial Sequence: Synthetic oligonucleotide
  Target: SOD1; (-) strand; PAM type: YTN; PAM sequence: TTC
ctggattcaggtgatcccct

SEQ ID NO: 11731 - DNA, 20 bp, Artificial Sequence
  Description of Artificial Sequence: Synthetic oligonucleotide
  Target: SOD1; (-) strand; PAM type: YTN; PAM sequence: CTT
cctggattcaggtgatcccc

SEQ ID NO: 11732 - DNA, 20 bp, Artificial Sequence
  Description of Artificial Sequence: Synthetic oligonucleotide
  Target: SOD1; (-) strand; PAM type: YTN; PAM sequence: CTC
gacttcctggattcaggtga

SEQ ID NO: 11733 - DNA, 20 bp, Artificial Sequence
  Description of Artificial Sequence: Synthetic oligonucleotide
  Target: SOD1; (-) strand; PAM type: YTN; PAM sequence: CTG
caccctcgacttcctggatt

SEQ ID NO: 11734 - DNA, 20 bp, Artificial Sequence
  Description of Artificial Sequence: Synthetic oligonucleotide
  Target: SOD1; (-) strand; PAM type: YTN; PAM sequence: CTC
actgcaccctcgacttcctg

SEQ ID NO: 11735 - DNA, 20 bp, Artificial Sequence
  Description of Artificial Sequence: Synthetic oligonucleotide
  Target: SOD1; (-) strand; PAM type: YTN; PAM sequence: CTC
ggctcactgcaccctcgact

SEQ ID NO: 11736 - DNA, 20 bp, Artificial Sequence
  Description of Artificial Sequence: Synthetic oligonucleotide
  Target: SOD1; (-) strand; PAM type: YTN; PAM sequence: CTG
gagtgtaacggcatgatctc

SEQ ID NO: 11737 - DNA, 20 bp, Artificial Sequence
  Description of Artificial Sequence: Synthetic oligonucleotide
  Target: SOD1; (-) strand; PAM type: YTN; PAM sequence: CTC
aggctggagtgtaacggcat

SEQ ID NO: 11738 - DNA, 20 bp, Artificial Sequence
  Description of Artificial Sequence: Synthetic oligonucleotide
  Target: SOD1; (-) strand; PAM type: YTN; PAM sequence: CTG
tcactcaggctggagtgtaa

SEQ ID NO: 11739 - DNA, 20 bp, Artificial Sequence
  Description of Artificial Sequence: Synthetic oligonucleotide
  Target: SOD1; (-) strand; PAM type: YTN; PAM sequence: CTC
tgtcactcaggctggagtgt

SEQ ID NO: 11740 - DNA, 20 bp, Artificial Sequence
  Description of Artificial Sequence: Synthetic oligonucleotide
  Target: SOD1; (-) strand; PAM type: YTN; PAM sequence: CTC
actctgtcactcaggctgga

SEQ ID NO: 11741 - DNA, 20 bp, Artificial Sequence
  Description of Artificial Sequence: Synthetic oligonucleotide
  Target: SOD1; (-) strand; PAM type: YTN; PAM sequence: TTG
acacaagatctcactctgtc

SEQ ID NO: 11742 - DNA, 20 bp, Artificial Sequence
  Description of Artificial Sequence: Synthetic oligonucleotide
  Target: SOD1; (-) strand; PAM type: YTN; PAM sequence: TTT
gacacaagatctcactctgt

SEQ ID NO: 11743 - DNA, 20 bp, Artificial Sequence
  Description of Artificial Sequence: Synthetic oligonucleotide
  Target: SOD1; (-) strand; PAM type: YTN; PAM sequence: TTT
tgacacaagatctcactctg

SEQ ID NO: 11744 - DNA, 20 bp, Artificial Sequence
  Description of Artificial Sequence: Synthetic oligonucleotide
  Target: SOD1; (-) strand; PAM type: YTN; PAM sequence: TTT
ttgacacaagatctcactct

SEQ ID NO: 11745 - DNA, 20 bp, Artificial Sequence
  Description of Artificial Sequence: Synthetic oligonucleotide
  Target: SOD1; (-) strand; PAM type: YTN; PAM sequence: TTT
tttgacacaagatctcactc

SEQ ID NO: 11746 - DNA, 20 bp, Artificial Sequence
  Description of Artificial Sequence: Synthetic oligonucleotide
  Target: SOD1; (-) strand; PAM type: YTN; PAM sequence: TTT
ttttgacacaagatctcact

SEQ ID NO: 11747 - DNA, 20 bp, Artificial Sequence
  Description of Artificial Sequence: Synthetic oligonucleotide
  Target: SOD1; (-) strand; PAM type: YTN; PAM sequence: CTG
tttttttgacacaagatctc

SEQ ID NO: 11748 - DNA, 20 bp, Artificial Sequence
  Description of Artificial Sequence: Synthetic oligonucleotide
  Target: SOD1; (-) strand; PAM type: YTN; PAM sequence: TTC
tgtttttttgacacaagatc

SEQ ID NO: 11749 - DNA, 20 bp, Artificial Sequence
  Description of Artificial Sequence: Synthetic oligonucleotide
  Target: SOD1; (-) strand; PAM type: YTN; PAM sequence: TTG
ttctgtttttttgacacaag

SEQ ID NO: 11750 - DNA, 20 bp, Artificial Sequence
  Description of Artificial Sequence: Synthetic oligonucleotide
  Target: SOD1; (-) strand; PAM type: YTN; PAM sequence: TTT
gttctgtttttttgacacaa

SEQ ID NO: 11751 - DNA, 20 bp, Artificial Sequence
  Description of Artificial Sequence: Synthetic oligonucleotide
  Target: SOD1; (-) strand; PAM type: YTN; PAM sequence: TTT
tgttctgtttttttgacaca

SEQ ID NO: 11752 - DNA, 20 bp, Artificial Sequence
  Description of Artificial Sequence: Synthetic oligonucleotide
  Target: SOD1; (-) strand; PAM type: YTN; PAM sequence: TTA
ttttgttctgtttttttgac

SEQ ID NO: 11753 - DNA, 20 bp, Artificial Sequence
  Description of Artificial Sequence: Synthetic oligonucleotide
  Target: SOD1; (-) strand; PAM type: YTN; PAM sequence: TTT
attttgttctgtttttttga

SEQ ID NO: 11754 - DNA, 20 bp, Artificial Sequence
  Description of Artificial Sequence: Synthetic oligonucleotide
  Target: SOD1; (-) strand; PAM type: YTN; PAM sequence: TTT
tattttgttctgtttttttg

SEQ ID NO: 11755 - DNA, 20 bp, Artificial Sequence
  Description of Artificial Sequence: Synthetic oligonucleotide
  Target: SOD1; (-) strand; PAM type: YTN; PAM sequence: TTG
ttttattttgttctgttttt

SEQ ID NO: 11756 - DNA, 20 bp, Artificial Sequence
  Description of Artificial Sequence: Synthetic oligonucleotide
  Target: SOD1; (-) strand; PAM type: YTN; PAM sequence: CTT
gttttattttgttctgtttt

SEQ ID NO: 11757 - DNA, 20 bp, Artificial Sequence
  Description of Artificial Sequence: Synthetic oligonucleotide
  Target: SOD1; (-) strand; PAM type: YTN; PAM sequence: TTC
ttgttttattttgttctgtt

SEQ ID NO: 11758 - DNA, 20 bp, Artificial Sequence
  Description of Artificial Sequence: Synthetic oligonucleotide
  Target: SOD1; (-) strand; PAM type: YTN; PAM sequence: TTC
aacgttcttgttttattttg

SEQ ID NO: 11759 - DNA, 20 bp, Artificial Sequence
  Description of Artificial Sequence: Synthetic oligonucleotide
  Target: SOD1; (-) strand; PAM type: YTN; PAM sequence: CTA
ttcaacgttcttgttttatt

SEQ ID NO: 11760 - DNA, 20 bp, Artificial Sequence
  Description of Artificial Sequence: Synthetic oligonucleotide
  Target: SOD1; (-) strand; PAM type: YTN; PAM sequence: TTA
acacacagcctattcaacgt

SEQ ID NO: 11761 - DNA, 20 bp, Artificial Sequence
  Description of Artificial Sequence: Synthetic oligonucleotide
  Target: SOD1; (-) strand; PAM type: YTN; PAM sequence: CTC
agaattaacacacagcctat

SEQ ID NO: 11762 - DNA, 20 bp, Artificial Sequence
  Description of Artificial Sequence: Synthetic oligonucleotide
  Target: SOD1; (-) strand; PAM type: YTN; PAM sequence: CTC
catctcagaattaacacaca

SEQ ID NO: 11763 - DNA, 20 bp, Artificial Sequence
  Description of Artificial Sequence: Synthetic oligonucleotide
  Target: SOD1; (-) strand; PAM type: YTN; PAM sequence: CTG
gactccatctcagaattaac

SEQ ID NO: 11764 - DNA, 20 bp, Artificial Sequence
  Description of Artificial Sequence: Synthetic oligonucleotide
  Target: SOD1; (-) strand; PAM type: YTN; PAM sequence: TTA
agtctggactccatctcaga

SEQ ID NO: 11765 - DNA, 20 bp, Artificial Sequence
  Description of Artificial Sequence: Synthetic oligonucleotide
  Target: SOD1; (-) strand; PAM type: YTN; PAM sequence: CTT
aagtctggactccatctcag

SEQ ID NO: 11766 - DNA, 20 bp, Artificial Sequence
  Description of Artificial Sequence: Synthetic oligonucleotide
  Target: SOD1; (-) strand; PAM type: YTN; PAM sequence: TTC
ttaagtctggactccatctc

SEQ ID NO: 11767 - DNA, 20 bp, Artificial Sequence
  Description of Artificial Sequence: Synthetic oligonucleotide
  Target: SOD1; (-) strand; PAM type: YTN; PAM sequence: CTC
aggatcattcttaagtctgg

SEQ ID NO: 11768 - DNA, 20 bp, Artificial Sequence
  Description of Artificial Sequence: Synthetic oligonucleotide
  Target: SOD1; (-) strand; PAM type: YTN; PAM sequence: CTA
agcctcaggatcattcttaa

SEQ ID NO: 11769 - DNA, 20 bp, Artificial Sequence
  Description of Artificial Sequence: Synthetic oligonucleotide
  Target: SOD1; (-) strand; PAM type: YTN; PAM sequence: TTG
gatatgggtctaagcctcag

SEQ ID NO: 11770 - DNA, 20 bp, Artificial Sequence
  Description of Artificial Sequence: Synthetic oligonucleotide
  Target: SOD1; (-) strand; PAM type: YTN; PAM sequence: CTT
ggatatgggtctaagcctca

SEQ ID NO: 11771 - DNA, 20 bp, Artificial Sequence
  Description of Artificial Sequence: Synthetic oligonucleotide
  Target: SOD1; (-) strand; PAM type: YTN; PAM sequence: CTC
ttggatatgggtctaagcct

SEQ ID NO: 11772 - DNA, 20 bp, Artificial Sequence
  Description of Artificial Sequence: Synthetic oligonucleotide
  Target: SOD1; (-) strand; PAM type: YTN; PAM sequence: CTG
gaatcatcctcttggatatg

SEQ ID NO: 11773 - DNA, 20 bp, Artificial Sequence
  Description of Artificial Sequence: Synthetic oligonucleotide
  Target: SOD1; (-) strand; PAM type: YTN; PAM sequence: CTA
taagtgccaggctggaatca

SEQ ID NO: 11774 - DNA, 20 bp, Artificial Sequence
  Description of Artificial Sequence: Synthetic oligonucleotide
  Target: SOD1; (-) strand; PAM type: YTN; PAM sequence: CTG
aagaacctataagtgccagg

SEQ ID NO: 11775 - DNA, 20 bp, Artificial Sequence
  Description of Artificial Sequence: Synthetic oligonucleotide
  Target: SOD1; (-) strand; PAM type: YTN; PAM sequence: CTG
aagtgcctgaagaacctata

SEQ ID NO: 11776 - DNA, 20 bp, Artificial Sequence
  Description of Artificial Sequence: Synthetic oligonucleotide
  Target: SOD1; (-) strand; PAM type: YTN; PAM sequence: TTC
aggacagggtgcatctgaag

SEQ ID NO: 11777 - DNA, 20 bp, Artificial Sequence
  Description of Artificial Sequence: Synthetic oligonucleotide
  Target: SOD1; (-) strand; PAM type: YTN; PAM sequence: TTA
attcaggacagggtgcatct

SEQ ID NO: 11778 - DNA, 20 bp, Artificial Sequence
  Description of Artificial Sequence: Synthetic oligonucleotide
  Target: SOD1; (-) strand; PAM type: YTN; PAM sequence: CTT
aattcaggacagggtgcatc

SEQ ID NO: 11779 - DNA, 20 bp, Artificial Sequence
  Description of Artificial Sequence: Synthetic oligonucleotide
  Target: SOD1; (-) strand; PAM type: YTN; PAM sequence: TTC
aaggacaaagggcttaattc

SEQ ID NO: 11780 - DNA, 20 bp, Artificial Sequence
  Description of Artificial Sequence: Synthetic oligonucleotide
  Target: SOD1; (-) strand; PAM type: YTN; PAM sequence: TTA
ccaaggaaagcaggttcaag

SEQ ID NO: 11781 - DNA, 20 bp, Artificial Sequence
  Description of Artificial Sequence: Synthetic oligonucleotide
  Target: SOD1; (-) strand; PAM type: YTN; PAM sequence: TTT
accaaggaaagcaggttcaa

SEQ ID NO: 11782 - DNA, 20 bp, Artificial Sequence
  Description of Artificial Sequence: Synthetic oligonucleotide
  Target: SOD1; (-) strand; PAM type: YTN; PAM sequence: CTG
tttaccaaggaaagcaggtt

SEQ ID NO: 11783 - DNA, 20 bp, Artificial Sequence
  Description of Artificial Sequence: Synthetic oligonucleotide
  Target: SOD1; (-) strand; PAM type: YTN; PAM sequence: TTG
gtgctgtttaccaaggaaag

SEQ ID NO: 11784 - DNA, 20 bp, Artificial Sequence
  Description of Artificial Sequence: Synthetic oligonucleotide
  Target: SOD1; (-) strand; PAM type: YTN; PAM sequence: CTT
ggtgctgtttaccaaggaaa

SEQ ID NO: 11785 - DNA, 20 bp, Artificial Sequence
  Description of Artificial Sequence: Synthetic oligonucleotide
  Target: SOD1; (-) strand; PAM type: YTN; PAM sequence: CTA
gcccccttggtgctgtttac

SEQ ID NO: 11786 - DNA, 20 bp, Artificial Sequence
  Description of Artificial Sequence: Synthetic oligonucleotide
  Target: SOD1; (-) strand; PAM type: YTN; PAM sequence: TTC
tagcccccttggtgctgttt

SEQ ID NO: 11787 - DNA, 20 bp, Artificial Sequence
  Description of Artificial Sequence: Synthetic oligonucleotide
  Target: SOD1; (-) strand; PAM type: YTN; PAM sequence: TTT
ctagcccccttggtgctgtt

SEQ ID NO: 11788 - DNA, 20 bp, Artificial Sequence
  Description of Artificial Sequence: Synthetic oligonucleotide
  Target: SOD1; (-) strand; PAM type: YTN; PAM sequence: TTA
gaggtgcatggtgagagagg

SEQ ID NO: 11789 - DNA, 20 bp, Artificial Sequence
  Description of Artificial Sequence: Synthetic oligonucleotide
  Target: SOD1; (-) strand; PAM type: YTN; PAM sequence: CTG
ggagatcacggaaatgcaac

SEQ ID NO: 11790 - DNA, 20 bp, Artificial Sequence
  Description of Artificial Sequence: Synthetic oligonucleotide
  Target: SOD1; (-) strand; PAM type: YTN; PAM sequence: CTG
gaagaaagctgggagatcac

SEQ ID NO: 11791 - DNA, 20 bp, Artificial Sequence
  Description of Artificial Sequence: Synthetic oligonucleotide
  Target: SOD1; (-) strand; PAM type: YTN; PAM sequence: CTA
aggccatcactggaagaaag

SEQ ID NO: 11792 - DNA, 20 bp, Artificial Sequence
  Description of Artificial Sequence: Synthetic oligonucleotide
  Target: SOD1; (-) strand; PAM type: YTN; PAM sequence: TTG
ggagacaggataagagccca

SEQ ID NO: 11793 - DNA, 20 bp, Artificial Sequence
  Description of Artificial Sequence: Synthetic oligonucleotide
  Target: SOD1; (-) strand; PAM type: YTN; PAM sequence: TTT
gggagacaggataagagccc

SEQ ID NO: 11794 - DNA, 20 bp, Artificial Sequence
  Description of Artificial Sequence: Synthetic oligonucleotide
  Target: SOD1; (-) strand; PAM type: YTN; PAM sequence: CTC
aaggcagagaggccatttgg

SEQ ID NO: 11795 - DNA, 20 bp, Artificial Sequence
  Description of Artificial Sequence: Synthetic oligonucleotide
  Target: SOD1; (-) strand; PAM type: YTN; PAM sequence: CTG
agagcagatggggtgagact

SEQ ID NO: 11796 - DNA, 20 bp, Artificial Sequence
  Description of Artificial Sequence: Synthetic oligonucleotide
  Target: SOD1; (-) strand; PAM type: YTN; PAM sequence: CTC
agtgggtggactgagagcag

SEQ ID NO: 11797 - DNA, 20 bp, Artificial Sequence
  Description of Artificial Sequence: Synthetic oligonucleotide
  Target: SOD1; (-) strand; PAM type: YTN; PAM sequence: CTG
gaatagctcagtgggtggac

SEQ ID NO: 11798 - DNA, 20 bp, Artificial Sequence
  Description of Artificial Sequence: Synthetic oligonucleotide
  Target: SOD1; (-) strand; PAM type: YTN; PAM sequence: CTC
tggaatagctcagtgggtgg

SEQ ID NO: 11799 - DNA, 20 bp, Artificial Sequence
  Description of Artificial Sequence: Synthetic oligonucleotide
  Target: SOD1; (-) strand; PAM type: YTN; PAM sequence: CTG
acagagaggagaagccacca

SEQ ID NO: 11800 - DNA, 20 bp, Artificial Sequence
  Description of Artificial Sequence: Synthetic oligonucleotide
  Target: SOD1; (-) strand; PAM type: YTN; PAM sequence: CTA
actgacagagaggagaagcc

SEQ ID NO: 11801 - DNA, 20 bp, Artificial Sequence
  Description of Artificial Sequence: Synthetic oligonucleotide
  Target: SOD1; (-) strand; PAM type: YTN; PAM sequence: TTC
taactgacagagaggagaag

SEQ ID NO: 11802 - DNA, 20 bp, Artificial Sequence
  Description of Artificial Sequence: Synthetic oligonucleotide
  Target: SOD1; (-) strand; PAM type: YTN; PAM sequence: TTT
ctaactgacagagaggagaa

SEQ ID NO: 11803 - DNA, 20 bp, Artificial Sequence
  Description of Artificial Sequence: Synthetic oligonucleotide
  Target: SOD1; (-) strand; PAM type: YTN; PAM sequence: TTA
catgcagtcaaaagcaattt

SEQ ID NO: 11804 - DNA, 20 bp, Artificial Sequence
  Description of Artificial Sequence: Synthetic oligonucleotide
  Target: SOD1; (-) strand; PAM type: YTN; PAM sequence: TTG
ttacatgcagtcaaaagcaa

SEQ ID NO: 11805 - DNA, 20 bp, Artificial Sequence
  Description of Artificial Sequence: Synthetic oligonucleotide
  Target: SOD1; (-) strand; PAM type: YTN; PAM sequence: TTT
gttacatgcagtcaaaagca

SEQ ID NO: 11806 - DNA, 20 bp, Artificial Sequence
  Description of Artificial Sequence: Synthetic oligonucleotide
  Target: SOD1; (-) strand; PAM type: YTN; PAM sequence: TTA
aatagcgtaaccacatttgt

SEQ ID NO: 11807 - DNA, 20 bp, Artificial Sequence
  Description of Artificial Sequence: Synthetic oligonucleotide
  Target: SOD1; (-) strand; PAM type: YTN; PAM sequence: TTG
gttaaatagcgtaaccacat

SEQ ID NO: 11808 - DNA, 20 bp, Artificial Sequence
  Description of Artificial Sequence: Synthetic oligonucleotide
  Target: SOD1; (-) strand; PAM type: YTN; PAM sequence: TTT
ggttaaatagcgtaaccaca

SEQ ID NO: 11809 - DNA, 20 bp, Artificial Sequence
  Description of Artificial Sequence: Synthetic oligonucleotide
  Target: SOD1; (-) strand; PAM type: YTN; PAM sequence: TTA
tttggttaaatagcgtaacc

SEQ ID NO: 11810 - DNA, 20 bp, Artificial Sequence
  Description of Artificial Sequence: Synthetic oligonucleotide
  Target: SOD1; (-) strand; PAM type: YTN; PAM sequence: TTT
atttggttaaatagcgtaac

SEQ ID NO: 11811 - DNA, 20 bp, Artificial Sequence
  Description of Artificial Sequence: Synthetic oligonucleotide
  Target: SOD1; (-) strand; PAM type: YTN; PAM sequence: CTT
tatttggttaaatagcgtaa

SEQ ID NO: 11812 - DNA, 20 bp, Artificial Sequence
  Description of Artificial Sequence: Synthetic oligonucleotide
  Target: SOD1; (-) strand; PAM type: YTN; PAM sequence: TTC
atcacgagaaaaataaacct

SEQ ID NO: 11813 - DNA, 20 bp, Artificial Sequence
  Description of Artificial Sequence: Synthetic oligonucleotide
  Target: SOD1; (-) strand; PAM type: YTN; PAM sequence: TTT
catcacgagaaaaataaacc

SEQ ID NO: 11814 - DNA, 20 bp, Artificial Sequence
  Description of Artificial Sequence: Synthetic oligonucleotide
  Target: SOD1; (-) strand; PAM type: YTN; PAM sequence: TTT
tcatcacgagaaaaataaac

SEQ ID NO: 11815 - DNA, 20 bp, Artificial Sequence
  Description of Artificial Sequence: Synthetic oligonucleotide
  Target: SOD1; (-) strand; PAM type: YTN; PAM sequence: CTT
ttcatcacgagaaaaataaa

SEQ ID NO: 11816 - DNA, 20 bp, Artificial Sequence
  Description of Artificial Sequence: Synthetic oligonucleotide
  Target: SOD1; (-) strand; PAM type: YTN; PAM sequence: CTG
tgtacttttcatcacgagaa

SEQ ID NO: 11817 - DNA, 20 bp, Artificial Sequence
  Description of Artificial Sequence: Synthetic oligonucleotide
  Target: SOD1; (-) strand; PAM type: YTN; PAM sequence: TTA
tctgtgtacttttcatcacg

SEQ ID NO: 11818 - DNA, 20 bp, Artificial Sequence
  Description of Artificial Sequence: Synthetic oligonucleotide
  Target: SOD1; (-) strand; PAM type: YTN; PAM sequence: CTT
atctgtgtacttttcatcac

SEQ ID NO: 11819 - DNA, 20 bp, Artificial Sequence
  Description of Artificial Sequence: Synthetic oligonucleotide
  Target: SOD1; (-) strand; PAM type: YTN; PAM sequence: CTG
cttatctgtgtacttttcat

SEQ ID NO: 11820 - DNA, 20 bp, Artificial Sequence
  Description of Artificial Sequence: Synthetic oligonucleotide
  Target: SOD1; (-) strand; PAM type: YTN; PAM sequence: TTA
tcgatggaagtaggctgctt

SEQ ID NO: 11821 - DNA, 20 bp, Artificial Sequence
  Description of Artificial Sequence: Synthetic oligonucleotide
  Target: SOD1; (-) strand; PAM type: YTN; PAM sequence: CTC
aatggttatcgatggaagta

SEQ ID NO: 11822 - DNA, 20 bp, Artificial Sequence
  Description of Artificial Sequence: Synthetic oligonucleotide
  Target: SOD1; (-) strand; PAM type: YTN; PAM sequence: CTG
taagagtcataagaaaccct

SEQ ID NO: 11823 - DNA, 20 bp, Artificial Sequence
  Description of Artificial Sequence: Synthetic oligonucleotide
  Target: SOD1; (-) strand; PAM type: YTN; PAM sequence: TTG
ctgtaagagtcataagaaac

SEQ ID NO: 11824 - DNA, 20 bp, Artificial Sequence
  Description of Artificial Sequence: Synthetic oligonucleotide
  Target: SOD1; (-) strand; PAM type: YTN; PAM sequence: TTC
attgctgtaagagtcataag

SEQ ID NO: 11825 - DNA, 20 bp, Artificial Sequence
  Description of Artificial Sequence: Synthetic oligonucleotide
  Target: SOD1; (-) strand; PAM type: YTN; PAM sequence: TTT
cattgctgtaagagtcataa

SEQ ID NO: 11826 - DNA, 20 bp, Artificial Sequence
  Description of Artificial Sequence: Synthetic oligonucleotide
  Target: SOD1; (-) strand; PAM type: YTN; PAM sequence: CTG
taaatacacatttcattgct

SEQ ID NO: 11827 - DNA, 20 bp, Artificial Sequence
  Description of Artificial Sequence: Synthetic oligonucleotide
  Target: SOD1; (-) strand; PAM type: YTN; PAM sequence: TTA
tactgtaaatacacatttca

SEQ ID NO: 11828 - DNA, 20 bp, Artificial Sequence
  Description of Artificial Sequence: Synthetic oligonucleotide
  Target: SOD1; (-) strand; PAM type: YTN; PAM sequence: TTT
atactgtaaatacacatttc

SEQ ID NO: 11829 - DNA, 20 bp, Artificial Sequence
  Description of Artificial Sequence: Synthetic oligonucleotide
  Target: SOD1; (-) strand; PAM type: YTN; PAM sequence: CTT
tatactgtaaatacacattt

SEQ ID NO: 11830 - DNA, 20 bp, Artificial Sequence
  Description of Artificial Sequence: Synthetic oligonucleotide
  Target: SOD1; (-) strand; PAM type: YTN; PAM sequence: TTG
tatatctttatactgtaaat

SEQ ID NO: 11831 - DNA, 20 bp, Artificial Sequence
  Description of Artificial Sequence: Synthetic oligonucleotide
  Target: SOD1; (-) strand; PAM type: YTN; PAM sequence: TTA
aaattgtatatctttatact

SEQ ID NO: 11832 - DNA, 20 bp, Artificial Sequence
  Description of Artificial Sequence: Synthetic oligonucleotide
  Target: SOD1; (-) strand; PAM type: YTN; PAM sequence: CTT
aaaattgtatatctttatac

SEQ ID NO: 11833 - DNA, 20 bp, Artificial Sequence
  Description of Artificial Sequence: Synthetic oligonucleotide
  Target: SOD1; (-) strand; PAM type: YTN; PAM sequence: TTA
aaaccttaaaattgtatatc

SEQ ID NO: 11834 - DNA, 20 bp, Artificial Sequence
  Description of Artificial Sequence: Synthetic oligonucleotide
  Target: SOD1; (-) strand; PAM type: YTN; PAM sequence: TTA
tattaaaaccttaaaattgt

SEQ ID NO: 11835 - DNA, 20 bp, Artificial Sequence
  Description of Artificial Sequence: Synthetic oligonucleotide
  Target: SOD1; (-) strand; PAM type: YTN; PAM sequence: TTA
ggcccaattatattaaaacc

SEQ ID NO: 11836 - DNA, 20 bp, Artificial Sequence
  Description of Artificial Sequence: Synthetic oligonucleotide
  Target: SOD1; (-) strand; PAM type: YTN; PAM sequence: CTT
aggcccaattatattaaaac

SEQ ID NO: 11837 - DNA, 20 bp, Artificial Sequence
  Description of Artificial Sequence: Synthetic oligonucleotide
  Target: SOD1; (-) strand; PAM type: YTN; PAM sequence: CTG
tgcttaggcccaattatatt

SEQ ID NO: 11838 - DNA, 20 bp, Artificial Sequence
  Description of Artificial Sequence: Synthetic oligonucleotide
  Target: SOD1; (-) strand; PAM type: YTN; PAM sequence: CTA
aaacaaaaaatactgtgctt

SEQ ID NO: 11839 - DNA, 20 bp, Artificial Sequence
  Description of Artificial Sequence: Synthetic oligonucleotide
  Target: SOD1; (-) strand; PAM type: YTN; PAM sequence: TTG
aaaactaaaacaaaaaatac

SEQ ID NO: 11840 - DNA, 20 bp, Artificial Sequence
  Description of Artificial Sequence: Synthetic oligonucleotide
  Target: SOD1; (-) strand; PAM type: YTN; PAM sequence: CTG
ggcagttgaaaactaaaaca

SEQ ID NO: 11841 - DNA, 20 bp, Artificial Sequence
  Description of Artificial Sequence: Synthetic oligonucleotide
  Target: SOD1; (-) strand; PAM type: YTN; PAM sequence: CTG
cacaatagaatcacctgggc

SEQ ID NO: 11842 - DNA, 20 bp, Artificial Sequence
  Description of Artificial Sequence: Synthetic oligonucleotide
  Target: SOD1; (-) strand; PAM type: YTN; PAM sequence: CTG
gctgcacaatagaatcacct

SEQ ID NO: 11843 - DNA, 20 bp, Artificial Sequence
  Description of Artificial Sequence: Synthetic oligonucleotide
  Target: SOD1; (-) strand; PAM type: YTN; PAM sequence: TTA
tcaaccctggctgcacaata

SEQ ID NO: 11844 - DNA, 20 bp, Artificial Sequence
  Description of Artificial Sequence: Synthetic oligonucleotide
  Target: SOD1; (-) strand; PAM type: YTN; PAM sequence: TTT
atcaaccctggctgcacaat

SEQ ID NO: 11845 - DNA, 20 bp, Artificial Sequence
  Description of Artificial Sequence: Synthetic oligonucleotide
  Target: SOD1; (-) strand; PAM type: YTN; PAM sequence: CTA
gatgcagtgtttatcaaccc

SEQ ID NO: 11846 - DNA, 20 bp, Artificial Sequence
  Description of Artificial Sequence: Synthetic oligonucleotide
  Target: SOD1; (-) strand; PAM type: YTN; PAM sequence: CTG
ggcctagatgcagtgtttat

SEQ ID NO: 11847 - DNA, 20 bp, Artificial Sequence
  Description of Artificial Sequence: Synthetic oligonucleotide
  Target: SOD1; (-) strand; PAM type: YTN; PAM sequence: CTG
caaatcaaaggcactgggcc

SEQ ID NO: 11848 - DNA, 20 bp, Artificial Sequence
  Description of Artificial Sequence: Synthetic oligonucleotide
  Target: SOD1; (-) strand; PAM type: YTN; PAM sequence: CTC
agctgcaaatcaaaggcact

SEQ ID NO: 11849 - DNA, 20 bp, Artificial Sequence
  Description of Artificial Sequence: Synthetic oligonucleotide
  Target: SOD1; (-) strand; PAM type: YTN; PAM sequence: CTA
gacctcagctgcaaatcaaa

SEQ ID NO: 11850 - DNA, 20 bp, Artificial Sequence
  Description of Artificial Sequence: Synthetic oligonucleotide
  Target: SOD1; (-) strand; PAM type: YTN; PAM sequence: CTC
tagacctcagctgcaaatca

SEQ ID NO: 11851 - DNA, 20 bp, Artificial Sequence
  Description of Artificial Sequence: Synthetic oligonucleotide
  Target: SOD1; (-) strand; PAM type: YTN; PAM sequence: CTC
tctagacctcagctgcaaat

SEQ ID NO: 11852 - DNA, 20 bp, Artificial Sequence
  Description of Artificial Sequence: Synthetic oligonucleotide
  Target: SOD1; (-) strand; PAM type: YTN; PAM sequence: TTC
tctctagacctcagctgcaa

SEQ ID NO: 11853 - DNA, 20 bp, Artificial Sequence
  Description of Artificial Sequence: Synthetic oligonucleotide
  Target: SOD1; (-) strand; PAM type: YTN; PAM sequence: TTC
aataattctctctagacctc

SEQ ID NO: 11854 - DNA, 20 bp, Artificial Sequence
  Description of Artificial Sequence: Synthetic oligonucleotide
  Target: SOD1; (-) strand; PAM type: YTN; PAM sequence: TTT
caataattctctctagacct

SEQ ID NO: 11855 - DNA, 20 bp, Artificial Sequence
  Description of Artificial Sequence: Synthetic oligonucleotide
  Target: SOD1; (-) strand; PAM type: YTN; PAM sequence: CTG
cagtttcaataattctctct

SEQ ID NO: 11856 - DNA, 20 bp, Artificial Sequence
  Description of Artificial Sequence: Synthetic oligonucleotide
  Target: SOD1; (-) strand; PAM type: YTN; PAM sequence: CTG
ggactgcagtttcaataatt

SEQ ID NO: 11857 - DNA, 20 bp, Artificial Sequence
  Description of Artificial Sequence: Synthetic oligonucleotide
  Target: SOD1; (-) strand; PAM type: YTN; PAM sequence: CTC
ccaagtagctgggactgcag

SEQ ID NO: 11858 - DNA, 20 bp, Artificial Sequence
  Description of Artificial Sequence: Synthetic oligonucleotide
  Target: SOD1; (-) strand; PAM type: YTN; PAM sequence: CTC
agcctcccaagtagctggga

SEQ ID NO: 11859 - DNA, 20 bp, Artificial Sequence
  Description of Artificial Sequence: Synthetic oligonucleotide
  Target: SOD1; (-) strand; PAM type: YTN; PAM sequence: CTC
caacctcagcctcccaagta

SEQ ID NO: 11860 - DNA, 20 bp, Artificial Sequence
  Description of Artificial Sequence: Synthetic oligonucleotide
  Target: SOD1; (-) strand; PAM type: YTN; PAM sequence: TTC
tccaacctcagcctcccaag

SEQ ID NO: 11861 - DNA, 20 bp, Artificial Sequence
  Description of Artificial Sequence: Synthetic oligonucleotide
  Target: SOD1; (-) strand; PAM type: YTN; PAM sequence: TTA
ggcaattctccaacctcagc

SEQ ID NO: 11862 - DNA, 20 bp, Artificial Sequence
  Description of Artificial Sequence: Synthetic oligonucleotide
  Target: SOD1; (-) strand; PAM type: YTN; PAM sequence: CTT
aggcaattctccaacctcag

SEQ ID NO: 11863 - DNA, 20 bp, Artificial Sequence
  Description of Artificial Sequence: Synthetic oligonucleotide
  Target: SOD1; (-) strand; PAM type: YTN; PAM sequence: CTG
ggcttaggcaattctccaac

SEQ ID NO: 11864 - DNA, 20 bp, Artificial Sequence
  Description of Artificial Sequence: Synthetic oligonucleotide
  Target: SOD1; (-) strand; PAM type: YTN; PAM sequence: CTC
accccgctgggcttaggcaa

SEQ ID NO: 11865 - DNA, 20 bp, Artificial Sequence
  Description of Artificial Sequence: Synthetic oligonucleotide
  Target: SOD1; (-) strand; PAM type: YTN; PAM sequence: CTA
cagcctcaccccgctgggct

SEQ ID NO: 11866 - DNA, 20 bp, Artificial Sequence
  Description of Artificial Sequence: Synthetic oligonucleotide
  Target: SOD1; (-) strand; PAM type: YTN; PAM sequence: CTC
actacagcctcaccccgctg

SEQ ID NO: 11867 - DNA, 20 bp, Artificial Sequence
  Description of Artificial Sequence: Synthetic oligonucleotide
  Target: SOD1; (-) strand; PAM type: YTN; PAM sequence: TTG
actcactacagcctcacccc

SEQ ID NO: 11868 - DNA, 20 bp, Artificial Sequence
  Description of Artificial Sequence: Synthetic oligonucleotide
  Target: SOD1; (-) strand; PAM type: YTN; PAM sequence: CTT
gactcactacagcctcaccc

SEQ ID NO: 11869 - DNA, 20 bp, Artificial Sequence
  Description of Artificial Sequence: Synthetic oligonucleotide
  Target: SOD1; (-) strand; PAM type: YTN; PAM sequence: CTG
gagtgcggtggtgcagtctt

SEQ ID NO: 11870 - DNA, 20 bp, Artificial Sequence
  Description of Artificial Sequence: Synthetic oligonucleotide
  Target: SOD1; (-) strand; PAM type: YTN; PAM sequence: CTG
tcgcccgggctggagtgcgg

SEQ ID NO: 11871 - DNA, 20 bp, Artificial Sequence
  Description of Artificial Sequence: Synthetic oligonucleotide
  Target: SOD1; (-) strand; PAM type: YTN; PAM sequence: CTC
tgtcgcccgggctggagtgc

SEQ ID NO: 11872 - DNA, 20 bp, Artificial Sequence
  Description of Artificial Sequence: Synthetic oligonucleotide
  Target: SOD1; (-) strand; PAM type: YTN; PAM sequence: TTG
ctctgtcgcccgggctggag

SEQ ID NO: 11873 - DNA, 20 bp, Artificial Sequence
  Description of Artificial Sequence: Synthetic oligonucleotide
  Target: SOD1; (-) strand; PAM type: YTN; PAM sequence: TTA
gatggagtgttgctctgtcg

SEQ ID NO: 11874 - DNA, 20 bp, Artificial Sequence
  Description of Artificial Sequence: Synthetic oligonucleotide
  Target: SOD1; (-) strand; PAM type: YTN; PAM sequence: TTT
agatggagtgttgctctgtc

SEQ ID NO: 11875 - DNA, 20 bp, Artificial Sequence
  Description of Artificial Sequence: Synthetic oligonucleotide
  Target: SOD1; (-) strand; PAM type: YTN; PAM sequence: TTT
tagatggagtgttgctctgt

SEQ ID NO: 11876 - DNA, 20 bp, Artificial Sequence
  Description of Artificial Sequence: Synthetic oligonucleotide
  Target: SOD1; (-) strand; PAM type: YTN; PAM sequence: TTT
ttagatggagtgttgctctg

SEQ ID NO: 11877 - DNA, 20 bp, Artificial Sequence
  Description of Artificial Sequence: Synthetic oligonucleotide
  Target: SOD1; (-) strand; PAM type: YTN; PAM sequence: TTT
tttagatggagtgttgctct

SEQ ID NO: 11878 - DNA, 20 bp, Artificial Sequence
  Description of Artificial Sequence: Synthetic oligonucleotide
  Target: SOD1; (-) strand; PAM type: YTN; PAM sequence: TTT
ttttagatggagtgttgctc

SEQ ID NO: 11879 - DNA, 20 bp, Artificial Sequence
  Description of Artificial Sequence: Synthetic oligonucleotide
  Target: SOD1; (-) strand; PAM type: YTN; PAM sequence: TTT
tttttagatggagtgttgct

SEQ ID NO: 11880 - DNA, 20 bp, Artificial Sequence
  Description of Artificial Sequence: Synthetic oligonucleotide
  Target: SOD1; (-) strand; PAM type: YTN; PAM sequence: TTT
ttttttagatggagtgttgc

SEQ ID NO: 11881 - DNA, 20 bp, Artificial Sequence
  Description of Artificial Sequence: Synthetic oligonucleotide
  Target: SOD1; (-) strand; PAM type: YTN; PAM sequence: TTT
tttttttagatggagtgttg

SEQ ID NO: 11882 - DNA, 20 bp, Artificial Sequence
  Description of Artificial Sequence: Synthetic oligonucleotide
  Target: SOD1; (-) strand; PAM type: YTN; PAM sequence: TTT
ttttttttagatggagtgtt

SEQ ID NO: 11883 - DNA, 20 bp, Artificial Sequence
  Description of Artificial Sequence: Synthetic oligonucleotide
  Target: SOD1; (-) strand; PAM type: YTN; PAM sequence: TTT
tttttttttagatggagtgt

SEQ ID NO: 11884 - DNA, 20 bp, Artificial Sequence
  Description of Artificial Sequence: Synthetic oligonucleotide
  Target: SOD1; (-) strand; PAM type: YTN; PAM sequence: TTT
ttttttttttagatggagtg

SEQ ID NO: 11885 - DNA, 20 bp, Artificial Sequence
  Description of Artificial Sequence: Synthetic oligonucleotide
  Target: SOD1; (-) strand; PAM type: YTN; PAM sequence: TTA
aaaggtgggcaaaaaggtag

SEQ ID NO: 11886 - DNA, 20 bp, Artificial Sequence
  Description of Artificial Sequence: Synthetic oligonucleotide
  Target: SOD1; (-) strand; PAM type: YTN; PAM sequence: CTG
tggttaaaaggtgggcaaaa

SEQ ID NO: 11887 - DNA, 20 bp, Artificial Sequence
  Description of Artificial Sequence: Synthetic oligonucleotide
  Target: SOD1; (-) strand; PAM type: YTN; PAM sequence: CTC
tgtggttaaaaggtgggcaa

SEQ ID NO: 11888 - DNA, 20 bp, Artificial Sequence
  Description of Artificial Sequence: Synthetic oligonucleotide
  Target: SOD1; (-) strand; PAM type: YTN; PAM sequence: TTG
gggacctctgtggttaaaag

SEQ ID NO: 11889 - DNA, 20 bp, Artificial Sequence
  Description of Artificial Sequence: Synthetic oligonucleotide
  Target: SOD1; (-) strand; PAM type: YTN; PAM sequence: TTT
ggggacctctgtggttaaaa

SEQ ID NO: 11890 - DNA, 20 bp, Artificial Sequence
  Description of Artificial Sequence: Synthetic oligonucleotide
  Target: SOD1; (-) strand; PAM type: YTN; PAM sequence: TTC
atgtttggggacctctgtgg

SEQ ID NO: 11891 - DNA, 20 bp, Artificial Sequence
  Description of Artificial Sequence: Synthetic oligonucleotide
  Target: SOD1; (-) strand; PAM type: YTN; PAM sequence: CTG
agagtgaaaattcatgtttg

SEQ ID NO: 11892 - DNA, 20 bp, Artificial Sequence
  Description of Artificial Sequence: Synthetic oligonucleotide
  Target: SOD1; (-) strand; PAM type: YTN; PAM sequence: TTC
ctgagagtgaaaattcatgt

SEQ ID NO: 11893 - DNA, 20 bp, Artificial Sequence
  Description of Artificial Sequence: Synthetic oligonucleotide
  Target: SOD1; (-) strand; PAM type: YTN; PAM sequence: CTT
cctgagagtgaaaattcatg

SEQ ID NO: 11894 - DNA, 20 bp, Artificial Sequence
  Description of Artificial Sequence: Synthetic oligonucleotide
  Target: SOD1; (-) strand; PAM type: YTN; PAM sequence: TTC
agccttcctgagagtgaaaa

SEQ ID NO: 11895 - DNA, 20 bp, Artificial Sequence
  Description of Artificial Sequence: Synthetic oligonucleotide
  Target: SOD1; (-) strand; PAM type: YTN; PAM sequence: TTT
cagccttcctgagagtgaaa

SEQ ID NO: 11896 - DNA, 20 bp, Artificial Sequence
  Description of Artificial Sequence: Synthetic oligonucleotide
  Target: SOD1; (-) strand; PAM type: YTN; PAM sequence: TTG
taatgtgtcatttcagcctt

SEQ ID NO: 11897 - DNA, 20 bp, Artificial Sequence
  Description of Artificial Sequence: Synthetic oligonucleotide
  Target: SOD1; (-) strand; PAM type: YTN; PAM sequence: CTT
gtaatgtgtcatttcagcct

SEQ ID NO: 11898 - DNA, 20 bp, Artificial Sequence
  Description of Artificial Sequence: Synthetic oligonucleotide
  Target: SOD1; (-) strand; PAM type: YTN; PAM sequence: CTA
aaccgcttgtaatgtgtcat

SEQ ID NO: 11899 - DNA, 20 bp, Artificial Sequence
  Description of Artificial Sequence: Synthetic oligonucleotide
  Target: SOD1; (-) strand; PAM type: YTN; PAM sequence: TTA
aatcagatggcggcacgtgc

SEQ ID NO: 11900 - DNA, 20 bp, Artificial Sequence
  Description of Artificial Sequence: Synthetic oligonucleotide
  Target: SOD1; (-) strand; PAM type: YTN; PAM sequence: CTT
aaatcagatggcggcacgtg

SEQ ID NO: 11901 - DNA, 20 bp, Artificial Sequence
  Description of Artificial Sequence: Synthetic oligonucleotide
  Target: SOD1; (-) strand; PAM type: YTN; PAM sequence: TTG
tcaggaatggtgaggaggaa

SEQ ID NO: 11902 - DNA, 20 bp, Artificial Sequence
  Description of Artificial Sequence: Synthetic oligonucleotide
  Target: SOD1; (-) strand; PAM type: YTN; PAM sequence: TTT
gtcaggaatggtgaggagga

SEQ ID NO: 11903 - DNA, 20 bp, Artificial Sequence
  Description of Artificial Sequence: Synthetic oligonucleotide
  Target: SOD1; (-) strand; PAM type: YTN; PAM sequence: CTT
tgtcaggaatggtgaggagg

SEQ ID NO: 11904 - DNA, 20 bp, Artificial Sequence
  Description of Artificial Sequence: Synthetic oligonucleotide
  Target: SOD1; (-) strand; PAM type: YTN; PAM sequence: TTC
aactttgtcaggaatggtga

SEQ ID NO: 11905 - DNA, 20 bp, Artificial Sequence
  Description of Artificial Sequence: Synthetic oligonucleotide
  Target: SOD1; (-) strand; PAM type: YTN; PAM sequence: TTA
gagaaagaggagaatgtggc

SEQ ID NO: 11906 - DNA, 20 bp, Artificial Sequence
  Description of Artificial Sequence: Synthetic oligonucleotide
  Target: SOD1; (-) strand; PAM type: YTN; PAM sequence: CTG
tcagaaagaagaaaagagag

SEQ ID NO: 11907 - DNA, 20 bp, Artificial Sequence
  Description of Artificial Sequence: Synthetic oligonucleotide
  Target: SOD1; (-) strand; PAM type: YTN; PAM sequence: TTA
aagaagcagaacaggcaaac

SEQ ID NO: 11908 - DNA, 20 bp, Artificial Sequence
  Description of Artificial Sequence: Synthetic oligonucleotide
  Target: SOD1; (-) strand; PAM type: YTN; PAM sequence: TTT
aaagaagcagaacaggcaaa

SEQ ID NO: 11909 - DNA, 20 bp, Artificial Sequence
  Description of Artificial Sequence: Synthetic oligonucleotide
  Target: SOD1; (-) strand; PAM type: YTN; PAM sequence: TTG
aaccccagggtttaaagaag

SEQ ID NO: 11910 - DNA, 20 bp, Artificial Sequence
  Description of Artificial Sequence: Synthetic oligonucleotide
  Target: SOD1; (-) strand; PAM type: YTN; PAM sequence: CTT
gaaccccagggtttaaagaa

SEQ ID NO: 11911 - DNA, 20 bp, Artificial Sequence
  Description of Artificial Sequence: Synthetic oligonucleotide
  Target: SOD1; (-) strand; PAM type: YTN; PAM sequence: TTG
cacttgaaccccagggttta

SEQ ID NO: 11912 - DNA, 20 bp, Artificial Sequence
  Description of Artificial Sequence: Synthetic oligonucleotide
  Target: SOD1; (-) strand; PAM type: YTN; PAM sequence: TTT
gcacttgaaccccagggttt

SEQ ID NO: 11913 - DNA, 20 bp, Artificial Sequence
  Description of Artificial Sequence: Synthetic oligonucleotide
  Target: SOD1; (-) strand; PAM type: YTN; PAM sequence: CTT
tgcacttgaaccccagggtt

SEQ ID NO: 11914 - DNA, 20 bp, Artificial Sequence
  Description of Artificial Sequence: Synthetic oligonucleotide
  Target: SOD1; (-) strand; PAM type: YTN; PAM sequence: TTA
aataaaataaaatagggaaa

SEQ ID NO: 11915 - DNA, 20 bp, Artificial Sequence
  Description of Artificial Sequence: Synthetic oligonucleotide
  Target: SOD1; (-) strand; PAM type: YTN; PAM sequence: CTT
aaataaaataaaatagggaa

SEQ ID NO: 11916 - DNA, 20 bp, Artificial Sequence
  Description of Artificial Sequence: Synthetic oligonucleotide
  Target: SOD1; (-) strand; PAM type: YTN; PAM sequence: CTA
acttaaataaaataaaatag

SEQ ID NO: 11917 - DNA, 20 bp, Artificial Sequence
  Description of Artificial Sequence: Synthetic oligonucleotide
  Target: SOD1; (-) strand; PAM type: YTN; PAM sequence: CTC
aacaataatcatcatcatca

SEQ ID NO: 11918 - DNA, 20 bp, Artificial Sequence
  Description of Artificial Sequence: Synthetic oligonucleotide
  Target: SOD1; (-) strand; PAM type: YTN; PAM sequence: CTG
tctcaacaataatcatcatc

SEQ ID NO: 11919 - DNA, 20 bp, Artificial Sequence
  Description of Artificial Sequence: Synthetic oligonucleotide
  Target: SOD1; (-) strand; PAM type: YTN; PAM sequence: CTG
ggcaacagaatgaaatcctg

SEQ ID NO: 11920 - DNA, 20 bp, Artificial Sequence
  Description of Artificial Sequence: Synthetic oligonucleotide
  Target: SOD1; (-) strand; PAM type: YTN; PAM sequence: CTC
cagcctgggcaacagaatga

SEQ ID NO: 11921 - DNA, 20 bp, Artificial Sequence
  Description of Artificial Sequence: Synthetic oligonucleotide
  Target: SOD1; (-) strand; PAM type: YTN; PAM sequence: TTG
cactccagcctgggcaacag

SEQ ID NO: 11922 - DNA, 20 bp, Artificial Sequence
  Description of Artificial Sequence: Synthetic oligonucleotide
  Target: SOD1; (-) strand; PAM type: YTN; PAM sequence: TTG
tgatcgcaccattgcactcc

SEQ ID NO: 11923 - DNA, 20 bp, Artificial Sequence
  Description of Artificial Sequence: Synthetic oligonucleotide
  Target: SOD1; (-) strand; PAM type: YTN; PAM sequence: CTG
cagtgagttgtgatcgcacc

SEQ ID NO: 11924 - DNA, 20 bp, Artificial Sequence
  Description of Artificial Sequence: Synthetic oligonucleotide
  Target: SOD1; (-) strand; PAM type: YTN; PAM sequence: TTG
aggctgcagtgagttgtgat

SEQ ID NO: 11925 - DNA, 20 bp, Artificial Sequence
  Description of Artificial Sequence: Synthetic oligonucleotide
  Target: SOD1; (-) strand; PAM type: YTN; PAM sequence: CTG
aggtaggaggatcgcgtggg

SEQ ID NO: 11926 - DNA, 20 bp, Artificial Sequence
  Description of Artificial Sequence: Synthetic oligonucleotide
  Target: SOD1; (-) strand; PAM type: YTN; PAM sequence: TTG
ggaggctgaggtaggaggat

SEQ ID NO: 11927 - DNA, 20 bp, Artificial Sequence
  Description of Artificial Sequence: Synthetic oligonucleotide
  Target: SOD1; (-) strand; PAM type: YTN; PAM sequence: CTT
gggaggctgaggtaggagga

SEQ ID NO: 11928 - DNA, 20 bp, Artificial Sequence
  Description of Artificial Sequence: Synthetic oligonucleotide
  Target: SOD1; (-) strand; PAM type: YTN; PAM sequence: CTA
cttgggaggctgaggtagga

SEQ ID NO: 11929 - DNA, 20 bp, Artificial Sequence
  Description of Artificial Sequence: Synthetic oligonucleotide
  Target: SOD1; (-) strand; PAM type: YTN; PAM sequence: CTG
tagtccaagctacttgggag

SEQ ID NO: 11930 - DNA, 20 bp, Artificial Sequence
  Description of Artificial Sequence: Synthetic oligonucleotide
  Target: SOD1; (-) strand; PAM type: YTN; PAM sequence: TTA
gccgggcatggtggtacacc

SEQ ID NO: 11931 - DNA, 20 bp, Artificial Sequence
  Description of Artificial Sequence: Synthetic oligonucleotide
  Target: SOD1; (-) strand; PAM type: YTN; PAM sequence: CTG
gcacatgtaattagccgggc

SEQ ID NO: 11932 - DNA, 20 bp, Artificial Sequence
  Description of Artificial Sequence: Synthetic oligonucleotide
  Target: SOD1; (-) strand; PAM type: YTN; PAM sequence: TTG
aatctggcacatgtaattag

SEQ ID NO: 11933 - DNA, 20 bp, Artificial Sequence
  Description of Artificial Sequence: Synthetic oligonucleotide
  Target: SOD1; (-) strand; PAM type: YTN; PAM sequence: CTG
gaacgtgggttgaatctggc

SEQ ID NO: 11934 - DNA, 20 bp, Artificial Sequence
  Description of Artificial Sequence: Synthetic oligonucleotide
  Target: SOD1; (-) strand; PAM type: YTN; PAM sequence: TTG
gaaccctggaacgtgggttg

SEQ ID NO: 11935 - DNA, 20 bp, Artificial Sequence
  Description of Artificial Sequence: Synthetic oligonucleotide
  Target: SOD1; (-) strand; PAM type: YTN; PAM sequence: TTT
ggaaccctggaacgtgggtt

SEQ ID NO: 11936 - DNA, 20 bp, Artificial Sequence
  Description of Artificial Sequence: Synthetic oligonucleotide
  Target: SOD1; (-) strand; PAM type: YTN; PAM sequence: TTG
tttggaaccctggaacgtgg

SEQ ID NO: 11937 - DNA, 20 bp, Artificial Sequence
  Description of Artificial Sequence: Synthetic oligonucleotide
  Target: SOD1; (-) strand; PAM type: YTN; PAM sequence: TTG
gttgtttggaaccctggaac

SEQ ID NO: 11938 - DNA, 20 bp, Artificial Sequence
  Description of Artificial Sequence: Synthetic oligonucleotide
  Target: SOD1; (-) strand; PAM type: YTN; PAM sequence: CTT
ggttgtttggaaccctggaa

SEQ ID NO: 11939 - DNA, 20 bp, Artificial Sequence
  Description of Artificial Sequence: Synthetic oligonucleotide
  Target: SOD1; (-) strand; PAM type: YTN; PAM sequence: TTA
agacaggatgatagagcctt

SEQ ID NO: 11940 - DNA, 20 bp, Artificial Sequence
  Description of Artificial Sequence: Synthetic oligonucleotide
  Target: SOD1; (-) strand; PAM type: YTN; PAM sequence: TTG
ttaagacaggatgatagagc

SEQ ID NO: 11941 - DNA, 20 bp, Artificial Sequence
  Description of Artificial Sequence: Synthetic oligonucleotide
  Target: SOD1; (-) strand; PAM type: YTN; PAM sequence: TTT
gttaagacaggatgatagag

SEQ ID NO: 11942 - DNA, 20 bp, Artificial Sequence
  Description of Artificial Sequence: Synthetic oligonucleotide
  Target: SOD1; (-) strand; PAM type: YTN; PAM sequence: TTA
tgaaggtatatttgttaaga

SEQ ID NO: 11943 - DNA, 20 bp, Artificial Sequence
  Description of Artificial Sequence: Synthetic oligonucleotide
  Target: SOD1; (-) strand; PAM type: YTN; PAM sequence: TTT
atgaaggtatatttgttaag

SEQ ID NO: 11944 - DNA, 20 bp, Artificial Sequence
  Description of Artificial Sequence: Synthetic oligonucleotide
  Target: SOD1; (-) strand; PAM type: YTN; PAM sequence: CTT
tatgaaggtatatttgttaa

SEQ ID NO: 11945 - DNA, 20 bp, Artificial Sequence
  Description of Artificial Sequence: Synthetic oligonucleotide
  Target: SOD1; (-) strand; PAM type: YTN; PAM sequence: TTC
caggtctttatgaaggtata

SEQ ID NO: 11946 - DNA, 20 bp, Artificial Sequence
  Description of Artificial Sequence: Synthetic oligonucleotide
  Target: SOD1; (-) strand; PAM type: YTN; PAM sequence: CTT
ccaggtctttatgaaggtat

SEQ ID NO: 11947 - DNA, 20 bp, Artificial Sequence
  Description of Artificial Sequence: Synthetic oligonucleotide
  Target: SOD1; (-) strand; PAM type: YTN; PAM sequence: CTG
ccttccaggtctttatgaag

SEQ ID NO: 11948 - DNA, 20 bp, Artificial Sequence
  Description of Artificial Sequence: Synthetic oligonucleotide
  Target: SOD1; (-) strand; PAM type: YTN; PAM sequence: TTC
aacctgccttccaggtcttt

SEQ ID NO: 11949 - DNA, 20 bp, Artificial Sequence
  Description of Artificial Sequence: Synthetic oligonucleotide
  Target: SOD1; (-) strand; PAM type: YTN; PAM sequence: TTT
caacctgccttccaggtctt

SEQ ID NO: 11950 - DNA, 20 bp, Artificial Sequence
  Description of Artificial Sequence: Synthetic oligonucleotide
  Target: SOD1; (-) strand; PAM type: YTN; PAM sequence: TTC
cacatttcaacctgccttcc

SEQ ID NO: 11951 - DNA, 20 bp, Artificial Sequence
  Description of Artificial Sequence: Synthetic oligonucleotide
  Target: SOD1; (-) strand; PAM type: YTN; PAM sequence: CTG
aaagaagtccaagaattcca

SEQ ID NO: 11952 - DNA, 20 bp, Artificial Sequence
  Description of Artificial Sequence: Synthetic oligonucleotide
  Target: SOD1; (-) strand; PAM type: YTN; PAM sequence: CTA
cgtagaactgaaagaagtcc

SEQ ID NO: 11953 - DNA, 20 bp, Artificial Sequence
  Description of Artificial Sequence: Synthetic oligonucleotide
  Target: SOD1; (-) strand; PAM type: YTN; PAM sequence: TTC
tacgtagaactgaaagaagt

SEQ ID NO: 11954 - DNA, 20 bp, Artificial Sequence
  Description of Artificial Sequence: Synthetic oligonucleotide
  Target: SOD1; (-) strand; PAM type: YTN; PAM sequence: CTT
ctacgtagaactgaaagaag

SEQ ID NO: 11955 - DNA, 20 bp, Artificial Sequence
  Description of Artificial Sequence: Synthetic oligonucleotide
  Target: SOD1; (-) strand; PAM type: YTN; PAM sequence: CTA
cccttctacgtagaactgaa

SEQ ID NO: 11956 - DNA, 20 bp, Artificial Sequence
  Description of Artificial Sequence: Synthetic oligonucleotide
  Target: SOD1; (-) strand; PAM type: YTN; PAM sequence: CTG
ctacccttctacgtagaact

SEQ ID NO: 11957 - DNA, 20 bp, Artificial Sequence
  Description of Artificial Sequence: Synthetic oligonucleotide
  Target: SOD1; (-) strand; PAM type: YTN; PAM sequence: CTC
cactgctacccttctacgta

SEQ ID NO: 11958 - DNA, 20 bp, Artificial Sequence
  Description of Artificial Sequence: Synthetic oligonucleotide
  Target: SOD1; (-) strand; PAM type: YTN; PAM sequence: CTC
tccactgctacccttctacg

SEQ ID NO: 11959 - DNA, 20 bp, Artificial Sequence
  Description of Artificial Sequence: Synthetic oligonucleotide
  Target: SOD1; (-) strand; PAM type: YTN; PAM sequence: CTG
cccagtgccacaaggagcag

SEQ ID NO: 11960 - DNA, 20 bp, Artificial Sequence
  Description of Artificial Sequence: Synthetic oligonucleotide
  Target: SOD1; (-) strand; PAM type: YTN; PAM sequence: TTG
aacgtaggccctgcccagtg

SEQ ID NO: 11961 - DNA, 20 bp, Artificial Sequence
  Description of Artificial Sequence: Synthetic oligonucleotide
  Target: SOD1; (-) strand; PAM type: YTN; PAM sequence: CTT
gaacgtaggccctgcccagt

SEQ ID NO: 11962 - DNA, 20 bp, Artificial Sequence
  Description of Artificial Sequence: Synthetic oligonucleotide
  Target: SOD1; (-) strand; PAM type: YTN; PAM sequence: CTA
gccttgaacgtaggccctgc

SEQ ID NO: 11963 - DNA, 20 bp, Artificial Sequence
  Description of Artificial Sequence: Synthetic oligonucleotide
  Target: SOD1; (-) strand; PAM type: YTN; PAM sequence: CTG
ctagccttgaacgtaggccc

SEQ ID NO: 11964 - DNA, 20 bp, Artificial Sequence
  Description of Artificial Sequence: Synthetic oligonucleotide
  Target: SOD1; (-) strand; PAM type: YTN; PAM sequence: TTG
agtacactgctagccttgaa

SEQ ID NO: 11965 - DNA, 20 bp, Artificial Sequence
  Description of Artificial Sequence: Synthetic oligonucleotide
  Target: SOD1; (-) strand; PAM type: YTN; PAM sequence: TTG
ttgagtacactgctagcctt

SEQ ID NO: 11966 - DNA, 20 bp, Artificial Sequence
  Description of Artificial Sequence: Synthetic oligonucleotide
  Target: SOD1; (-) strand; PAM type: YTN; PAM sequence: CTT
gttgagtacactgctagcct

SEQ ID NO: 11967 - DNA, 20 bp, Artificial Sequence
  Description of Artificial Sequence: Synthetic oligonucleotide
  Target: SOD1; (-) strand; PAM type: YTN; PAM sequence: CTG
tcccttgttgagtacactgc

SEQ ID NO: 11968 - DNA, 20 bp, Artificial Sequence
  Description of Artificial Sequence: Synthetic oligonucleotide
  Target: SOD1; (-) strand; PAM type: YTN; PAM sequence: CTG
aacaggccacacagggactg

SEQ ID NO: 11969 - DNA, 20 bp, Artificial Sequence
  Description of Artificial Sequence: Synthetic oligonucleotide
  Target: SOD1; (-) strand; PAM type: YTN; PAM sequence: CTG
tgtataggatcctgaacagg

SEQ ID NO: 11970 - DNA, 20 bp, Artificial Sequence
  Description of Artificial Sequence: Synthetic oligonucleotide
  Target: SOD1; (-) strand; PAM type: YTN; PAM sequence: CTG
agcctgtgtataggatcctg

SEQ ID NO: 11971 - DNA, 20 bp, Artificial Sequence
  Description of Artificial Sequence: Synthetic oligonucleotide
  Target: SOD1; (-) strand; PAM type: YTN; PAM sequence: CTG
cccaaagagccctgagcctg

SEQ ID NO: 11972 - DNA, 20 bp, Artificial Sequence
  Description of Artificial Sequence: Synthetic oligonucleotide
  Target: SOD1; (-) strand; PAM type: YTN; PAM sequence: TTC
ctgcccaaagagccctgagc

SEQ ID NO: 11973 - DNA, 20 bp, Artificial Sequence
  Description of Artificial Sequence: Synthetic oligonucleotide
  Target: SOD1; (-) strand; PAM type: YTN; PAM sequence: TTT
cctgcccaaagagccctgag

SEQ ID NO: 11974 - DNA, 20 bp, Artificial Sequence
  Description of Artificial Sequence: Synthetic oligonucleotide
  Target: SOD1; (-) strand; PAM type: YTN; PAM sequence: CTG
gaatttcctgcccaaagagc

SEQ ID NO: 11975 - DNA, 20 bp, Artificial Sequence
  Description of Artificial Sequence: Synthetic oligonucleotide
  Target: SOD1; (-) strand; PAM type: YTN; PAM sequence: TTG
agtacccggatcctggaatt

SEQ ID NO: 11976 - DNA, 20 bp, Artificial Sequence
  Description of Artificial Sequence: Synthetic oligonucleotide
  Target: SOD1; (-) strand; PAM type: YTN; PAM sequence: CTT
gagtacccggatcctggaat

SEQ ID NO: 11977 - DNA, 20 bp, Artificial Sequence
  Description of Artificial Sequence: Synthetic oligonucleotide
  Target: SOD1; (-) strand; PAM type: YTN; PAM sequence: TTA
gaacaccacttgagtacccg

SEQ ID NO: 11978 - DNA, 20 bp, Artificial Sequence
  Description of Artificial Sequence: Synthetic oligonucleotide
  Target: SOD1; (-) strand; PAM type: YTN; PAM sequence: TTT
agaacaccacttgagtaccc

SEQ ID NO: 11979 - DNA, 20 bp, Artificial Sequence
  Description of Artificial Sequence: Synthetic oligonucleotide
  Target: SOD1; (-) strand; PAM type: YTN; PAM sequence: CTG
tttagaacaccacttgagta

SEQ ID NO: 11980 - DNA, 20 bp, Artificial Sequence
  Description of Artificial Sequence: Synthetic oligonucleotide
  Target: SOD1; (-) strand; PAM type: YTN; PAM sequence: TTA
caggtgtgagccaccacacc

SEQ ID NO: 11981 - DNA, 20 bp, Artificial Sequence
  Description of Artificial Sequence: Synthetic oligonucleotide
  Target: SOD1; (-) strand; PAM type: YTN; PAM sequence: CTG
ggattacaggtgtgagccac

SEQ ID NO: 11982 - DNA, 20 bp, Artificial Sequence
  Description of Artificial Sequence: Synthetic oligonucleotide
  Target: SOD1; (-) strand; PAM type: YTN; PAM sequence: CTC
ccaaagtgctgggattacag

SEQ ID NO: 11983 - DNA, 20 bp, Artificial Sequence
  Description of Artificial Sequence: Synthetic oligonucleotide
  Target: SOD1; (-) strand; PAM type: YTN; PAM sequence: CTC
ggcctcccaaagtgctggga

SEQ ID NO: 11984 - DNA, 20 bp, Artificial Sequence
  Description of Artificial Sequence: Synthetic oligonucleotide
  Target: SOD1; (-) strand; PAM type: YTN; PAM sequence: CTG
ccagcctcggcctcccaaag

SEQ ID NO: 11985 - DNA, 20 bp, Artificial Sequence
  Description of Artificial Sequence: Synthetic oligonucleotide
  Target: SOD1; (-) strand; PAM type: YTN; PAM sequence: CTC
aagtgatctgccagcctcgg

SEQ ID NO: 11986 - DNA, 20 bp, Artificial Sequence
  Description of Artificial Sequence: Synthetic oligonucleotide
  Target: SOD1; (-) strand; PAM type: YTN; PAM sequence: CTG
acctcaagtgatctgccagc

SEQ ID NO: 11987 - DNA, 20 bp, Artificial Sequence
  Description of Artificial Sequence: Synthetic oligonucleotide
  Target: SOD1; (-) strand; PAM type: YTN; PAM sequence: CTC
ctgacctcaagtgatctgcc

SEQ ID NO: 11988 - DNA, 20 bp, Artificial Sequence
  Description of Artificial Sequence: Synthetic oligonucleotide
  Target: SOD1; (-) strand; PAM type: YTN; PAM sequence: CTC
gaactcctgacctcaagtga

SEQ ID NO: 11989 - DNA, 20 bp, Artificial Sequence
  Description of Artificial Sequence: Synthetic oligonucleotide
  Target: SOD1; (-) strand; PAM type: YTN; PAM sequence: CTG
gtctcgaactcctgacctca

SEQ ID NO: 11990 - DNA, 20 bp, Artificial Sequence
  Description of Artificial Sequence: Synthetic oligonucleotide
  Target: SOD1; (-) strand; PAM type: YTN; PAM sequence: TTG
gccaggctggtctcgaactc

SEQ ID NO: 11991 - DNA, 20 bp, Artificial Sequence
  Description of Artificial Sequence: Synthetic oligonucleotide
  Target: SOD1; (-) strand; PAM type: YTN; PAM sequence: TTC
accatgttggccaggctggt

SEQ ID NO: 11992 - DNA, 20 bp, Artificial Sequence
  Description of Artificial Sequence: Synthetic oligonucleotide
  Target: SOD1; (-) strand; PAM type: YTN; PAM sequence: TTT
caccatgttggccaggctgg

SEQ ID NO: 11993 - DNA, 20 bp, Artificial Sequence
  Description of Artificial Sequence: Synthetic oligonucleotide
  Target: SOD1; (-) strand; PAM type: YTN; PAM sequence: TTA
gtagagatggggtttcacca

SEQ ID NO: 11994 - DNA, 20 bp, Artificial Sequence
  Description of Artificial Sequence: Synthetic oligonucleotide
  Target: SOD1; (-) strand; PAM type: YTN; PAM sequence: TTT
agtagagatggggtttcacc

SEQ ID NO: 11995 - DNA, 20 bp, Artificial Sequence
  Description of Artificial Sequence: Synthetic oligonucleotide
  Target: SOD1; (-) strand; PAM type: YTN; PAM sequence: TTT
tagtagagatggggtttcac

SEQ ID NO: 11996 - DNA, 20 bp, Artificial Sequence
  Description of Artificial Sequence: Synthetic oligonucleotide
  Target: SOD1; (-) strand; PAM type: YTN; PAM sequence: TTT
ttagtagagatggggtttca

SEQ ID NO: 11997 - DNA, 20 bp, Artificial Sequence
  Description of Artificial Sequence: Synthetic oligonucleotide
  Target: SOD1; (-) strand; PAM type: YTN; PAM sequence: TTG
tatttttagtagagatgggg

SEQ ID NO: 11998 - DNA, 20 bp, Artificial Sequence
  Description of Artificial Sequence: Synthetic oligonucleotide
  Target: SOD1; (-) strand; PAM type: YTN; PAM sequence: TTT
gtatttttagtagagatggg

SEQ ID NO: 11999 - DNA, 20 bp, Artificial Sequence
  Description of Artificial Sequence: Synthetic oligonucleotide
  Target: SOD1; (-) strand; PAM type: YTN; PAM sequence: TTT
tgtatttttagtagagatgg

SEQ ID NO: 12000 - DNA, 20 bp, Artificial Sequence
  Description of Artificial Sequence: Synthetic oligonucleotide
  Target: SOD1; (-) strand; PAM type: YTN; PAM sequence: TTT
ttgtatttttagtagagatg

SEQ ID NO: 12001 - DNA, 20 bp, Artificial Sequence
  Description of Artificial Sequence: Synthetic oligonucleotide
  Target: SOD1; (-) strand; PAM type: YTN; PAM sequence: CTA
agtttttgtatttttagtag

SEQ ID NO: 12002 - DNA, 20 bp, Artificial Sequence
  Description of Artificial Sequence: Synthetic oligonucleotide
  Target: SOD1; (-) strand; PAM type: YTN; PAM sequence: CTG
gctaagtttttgtattttta

SEQ ID NO: 12003 - DNA, 20 bp, Artificial Sequence
  Description of Artificial Sequence: Synthetic oligonucleotide
  Target: SOD1; (-) strand; PAM type: YTN; PAM sequence: CTA
caggcgtgcacaccatgcct

SEQ ID NO: 12004 - DNA, 20 bp, Artificial Sequence
  Description of Artificial Sequence: Synthetic oligonucleotide
  Target: SOD1; (-) strand; PAM type: YTN; PAM sequence: CTG
ggactacaggcgtgcacacc

SEQ ID NO: 12005 - DNA, 20 bp, Artificial Sequence
  Description of Artificial Sequence: Synthetic oligonucleotide
  Target: SOD1; (-) strand; PAM type: YTN; PAM sequence: CTC
ccgagtagctgggactacag

SEQ ID NO: 12006 - DNA, 20 bp, Artificial Sequence
  Description of Artificial Sequence: Synthetic oligonucleotide
  Target: SOD1; (-) strand; PAM type: YTN; PAM sequence: CTC
agcctcccgagtagctggga

SEQ ID NO: 12007 - DNA, 20 bp, Artificial Sequence
  Description of Artificial Sequence: Synthetic oligonucleotide
  Target: SOD1; (-) strand; PAM type: YTN; PAM sequence: CTG
cctcagcctcccgagtagct

SEQ ID NO: 12008 - DNA, 20 bp, Artificial Sequence
  Description of Artificial Sequence: Synthetic oligonucleotide
  Target: SOD1; (-) strand; PAM type: YTN; PAM sequence: CTC
ctgcctcagcctcccgagta

SEQ ID NO: 12009 - DNA, 20 bp, Artificial Sequence
  Description of Artificial Sequence: Synthetic oligonucleotide
  Target: SOD1; (-) strand; PAM type: YTN; PAM sequence: TTC
tcctgcctcagcctcccgag

SEQ ID NO: 12010 - DNA, 20 bp, Artificial Sequence
  Description of Artificial Sequence: Synthetic oligonucleotide
  Target: SOD1; (-) strand; PAM type: YTN; PAM sequence: TTC
aagtgattctcctgcctcag

SEQ ID NO: 12011 - DNA, 20 bp, Artificial Sequence
  Description of Artificial Sequence: Synthetic oligonucleotide
  Target: SOD1; (-) strand; PAM type: YTN; PAM sequence: CTG
ggttcaagtgattctcctgc

SEQ ID NO: 12012 - DNA, 20 bp, Artificial Sequence
  Description of Artificial Sequence: Synthetic oligonucleotide
  Target: SOD1; (-) strand; PAM type: YTN; PAM sequence: CTG
ctgggttcaagtgattctcc

SEQ ID NO: 12013 - DNA, 20 bp, Artificial Sequence
  Description of Artificial Sequence: Synthetic oligonucleotide
  Target: SOD1; (-) strand; PAM type: YTN; PAM sequence: CTC
cgcctgctgggttcaagtga

SEQ ID NO: 12014 - DNA, 20 bp, Artificial Sequence
  Description of Artificial Sequence: Synthetic oligonucleotide
  Target: SOD1; (-) strand; PAM type: YTN; PAM sequence: CTG
caacctccgcctgctgggtt

SEQ ID NO: 12015 - DNA, 20 bp, Artificial Sequence
  Description of Artificial Sequence: Synthetic oligonucleotide
  Target: SOD1; (-) strand; PAM type: YTN; PAM sequence: CTC
actgcaacctccgcctgctg

SEQ ID NO: 12016 - DNA, 20 bp, Artificial Sequence
  Description of Artificial Sequence: Synthetic oligonucleotide
  Target: SOD1; (-) strand; PAM type: YTN; PAM sequence: CTC
agctcactgcaacctccgcc

SEQ ID NO: 12017 - DNA, 20 bp, Artificial Sequence
  Description of Artificial Sequence: Synthetic oligonucleotide
  Target: SOD1; (-) strand; PAM type: YTN; PAM sequence: CTG
gagtgcagtggtgcaatctc

SEQ ID NO: 12018 - DNA, 20 bp, Artificial Sequence
  Description of Artificial Sequence: Synthetic oligonucleotide
  Target: SOD1; (-) strand; PAM type: YTN; PAM sequence: CTG
tcaccaggctggagtgcagt

SEQ ID NO: 12019 - DNA, 20 bp, Artificial Sequence
  Description of Artificial Sequence: Synthetic oligonucleotide
  Target: SOD1; (-) strand; PAM type: YTN; PAM sequence: CTC
tgtcaccaggctggagtgca

SEQ ID NO: 12020 - DNA, 20 bp, Artificial Sequence
  Description of Artificial Sequence: Synthetic oligonucleotide
  Target: SOD1; (-) strand; PAM type: YTN; PAM sequence: CTC
actctgtcaccaggctggag

SEQ ID NO: 12021 - DNA, 20 bp, Artificial Sequence
  Description of Artificial Sequence: Synthetic oligonucleotide
  Target: SOD1; (-) strand; PAM type: YTN; PAM sequence: TTG
atatggagtctcactctgtc

SEQ ID NO: 12022 - DNA, 20 bp, Artificial Sequence
  Description of Artificial Sequence: Synthetic oligonucleotide
  Target: SOD1; (-) strand; PAM type: YTN; PAM sequence: TTT
gatatggagtctcactctgt

SEQ ID NO: 12023 - DNA, 20 bp, Artificial Sequence
  Description of Artificial Sequence: Synthetic oligonucleotide
  Target: SOD1; (-) strand; PAM type: YTN; PAM sequence: TTT
tgatatggagtctcactctg

SEQ ID NO: 12024 - DNA, 20 bp, Artificial Sequence
  Description of Artificial Sequence: Synthetic oligonucleotide
  Target: SOD1; (-) strand; PAM type: YTN; PAM sequence: TTA
ttttgatatggagtctcact

SEQ ID NO: 12025 - DNA, 20 bp, Artificial Sequence
  Description of Artificial Sequence: Synthetic oligonucleotide
  Target: SOD1; (-) strand; PAM type: YTN; PAM sequence: TTT
attttgatatggagtctcac

SEQ ID NO: 12026 - DNA, 20 bp, Artificial Sequence
  Description of Artificial Sequence: Synthetic oligonucleotide
  Target: SOD1; (-) strand; PAM type: YTN; PAM sequence: TTA
tgtatttattttgatatgga

SEQ ID NO: 12027 - DNA, 20 bp, Artificial Sequence
  Description of Artificial Sequence: Synthetic oligonucleotide
  Target: SOD1; (-) strand; PAM type: YTN; PAM sequence: TTT
atgtatttattttgatatgg

SEQ ID NO: 12028 - DNA, 20 bp, Artificial Sequence
  Description of Artificial Sequence: Synthetic oligonucleotide
  Target: SOD1; (-) strand; PAM type: YTN; PAM sequence: TTA
tttatgtatttattttgata

SEQ ID NO: 12029 - DNA, 20 bp, Artificial Sequence
  Description of Artificial Sequence: Synthetic oligonucleotide
  Target: SOD1; (-) strand; PAM type: YTN; PAM sequence: TTT
atttatgtatttattttgat

SEQ ID NO: 12030 - DNA, 20 bp, Artificial Sequence
  Description of Artificial Sequence: Synthetic oligonucleotide
  Target: SOD1; (-) strand; PAM type: YTN; PAM sequence: TTA
tttatttatgtatttatttt

SEQ ID NO: 12031 - DNA, 20 bp, Artificial Sequence
  Description of Artificial Sequence: Synthetic oligonucleotide
  Target: SOD1; (-) strand; PAM type: YTN; PAM sequence: TTT
atttatttatgtatttattt

SEQ ID NO: 12032 - DNA, 20 bp, Artificial Sequence
  Description of Artificial Sequence: Synthetic oligonucleotide
  Target: SOD1; (-) strand; PAM type: YTN; PAM sequence: TTT
tatttatttatgtatttatt

SEQ ID NO: 12033 - DNA, 20 bp, Artificial Sequence
  Description of Artificial Sequence: Synthetic oligonucleotide
  Target: SOD1; (-) strand; PAM type: YTN; PAM sequence: TTT
ttatttatttatgtatttat

SEQ ID NO: 12034 - DNA, 20 bp, Artificial Sequence
  Description of Artificial Sequence: Synthetic oligonucleotide
  Target: SOD1; (-) strand; PAM type: YTN; PAM sequence: CTG
tttttatttatttatgtatt

SEQ ID NO: 12035 - DNA, 20 bp, Artificial Sequence
  Description of Artificial Sequence: Synthetic oligonucleotide
  Target: SOD1; (-) strand; PAM type: YTN; PAM sequence: TTA
agaatcactgtttttattta

SEQ ID NO: 12036 - DNA, 20 bp, Artificial Sequence
  Description of Artificial Sequence: Synthetic oligonucleotide
  Target: SOD1; (-) strand; PAM type: YTN; PAM sequence: CTC
ccagttaagaatcactgttt

SEQ ID NO: 12037 - DNA, 20 bp, Artificial Sequence
  Description of Artificial Sequence: Synthetic oligonucleotide
  Target: SOD1; (-) strand; PAM type: YTN; PAM sequence: TTG
ccaaatcactcccagttaag

SEQ ID NO: 12038 - DNA, 20 bp, Artificial Sequence
  Description of Artificial Sequence: Synthetic oligonucleotide
  Target: SOD1; (-) strand; PAM type: YTN; PAM sequence: TTC
cagacgttgccaaatcactc

SEQ ID NO: 12039 - DNA, 20 bp, Artificial Sequence
  Description of Artificial Sequence: Synthetic oligonucleotide
  Target: SOD1; (-) strand; PAM type: YTN; PAM sequence: CTG
ggataaccaaaaataattcc

SEQ ID NO: 12040 - DNA, 20 bp, Artificial Sequence
  Description of Artificial Sequence: Synthetic oligonucleotide
  Target: SOD1; (-) strand; PAM type: YTN; PAM sequence: CTG
ccaggctgggataaccaaaa

SEQ ID NO: 12041 - DNA, 20 bp, Artificial Sequence
  Description of Artificial Sequence: Synthetic oligonucleotide
  Target: SOD1; (-) strand; PAM type: YTN; PAM sequence: CTC
cctgccaggctgggataacc

SEQ ID NO: 12042 - DNA, 20 bp, Artificial Sequence
  Description of Artificial Sequence: Synthetic oligonucleotide
  Target: SOD1; (-) strand; PAM type: YTN; PAM sequence: CTG
tccctccctgccaggctggg

SEQ ID NO: 12043 - DNA, 20 bp, Artificial Sequence
  Description of Artificial Sequence: Synthetic oligonucleotide
  Target: SOD1; (-) strand; PAM type: YTN; PAM sequence: CTA
gatgccagtaataccctgtc

SEQ ID NO: 12044 - DNA, 20 bp, Artificial Sequence
  Description of Artificial Sequence: Synthetic oligonucleotide
  Target: SOD1; (-) strand; PAM type: YTN; PAM sequence: CTC
actagatgccagtaataccc

SEQ ID NO: 12045 - DNA, 20 bp, Artificial Sequence
  Description of Artificial Sequence: Synthetic oligonucleotide
  Target: SOD1; (-) strand; PAM type: YTN; PAM sequence: CTA
ctcactagatgccagtaata

SEQ ID NO: 12046 - DNA, 20 bp, Artificial Sequence
  Description of Artificial Sequence: Synthetic oligonucleotide
  Target: SOD1; (-) strand; PAM type: YTN; PAM sequence: CTA
gcccctactcactagatgcc

SEQ ID NO: 12047 - DNA, 20 bp, Artificial Sequence
  Description of Artificial Sequence: Synthetic oligonucleotide
  Target: SOD1; (-) strand; PAM type: YTN; PAM sequence: TTC
agtagaatccctagccccta

SEQ ID NO: 12048 - DNA, 20 bp, Artificial Sequence
  Description of Artificial Sequence: Synthetic oligonucleotide
  Target: SOD1; (-) strand; PAM type: YTN; PAM sequence: CTG
taggatgttcagtagaatcc

SEQ ID NO: 12049 - DNA, 20 bp, Artificial Sequence
  Description of Artificial Sequence: Synthetic oligonucleotide
  Target: SOD1; (-) strand; PAM type: YTN; PAM sequence: CTG
tacactgtaggatgttcagt

SEQ ID NO: 12050 - DNA, 20 bp, Artificial Sequence
  Description of Artificial Sequence: Synthetic oligonucleotide
  Target: SOD1; (-) strand; PAM type: YTN; PAM sequence: CTG
tcctgtacactgtaggatgt

SEQ ID NO: 12051 - DNA, 20 bp, Artificial Sequence
  Description of Artificial Sequence: Synthetic oligonucleotide
  Target: SOD1; (-) strand; PAM type: YTN; PAM sequence: CTG
tggaggctgtcctgtacact

SEQ ID NO: 12052 - DNA, 20 bp, Artificial Sequence
  Description of Artificial Sequence: Synthetic oligonucleotide
  Target: SOD1; (-) strand; PAM type: YTN; PAM sequence: TTG
ctgtggaggctgtcctgtac

SEQ ID NO: 12053 - DNA, 20 bp, Artificial Sequence
  Description of Artificial Sequence: Synthetic oligonucleotide
  Target: SOD1; (-) strand; PAM type: YTN; PAM sequence: TTT
gctgtggaggctgtcctgta

SEQ ID NO: 12054 - DNA, 20 bp, Artificial Sequence
  Description of Artificial Sequence: Synthetic oligonucleotide
  Target: SOD1; (-) strand; PAM type: YTN; PAM sequence: CTT
tgctgtggaggctgtcctgt

SEQ ID NO: 12055 - DNA, 20 bp, Artificial Sequence
  Description of Artificial Sequence: Synthetic oligonucleotide
  Target: SOD1; (-) strand; PAM type: YTN; PAM sequence: TTC
tttgctgtggaggctgtcct

SEQ ID NO: 12056 - DNA, 20 bp, Artificial Sequence
  Description of Artificial Sequence: Synthetic oligonucleotide
  Target: SOD1; (-) strand; PAM type: YTN; PAM sequence: TTG
ggccagacagttctttgctg

SEQ ID NO: 12057 - DNA, 20 bp, Artificial Sequence
  Description of Artificial Sequence: Synthetic oligonucleotide
  Target: SOD1; (-) strand; PAM type: YTN; PAM sequence: TTT
gggccagacagttctttgct

SEQ ID NO: 12058 - DNA, 20 bp, Artificial Sequence
  Description of Artificial Sequence: Synthetic oligonucleotide
  Target: SOD1; (-) strand; PAM type: YTN; PAM sequence: TTT
tgggccagacagttctttgc

SEQ ID NO: 12059 - DNA, 20 bp, Artificial Sequence
  Description of Artificial Sequence: Synthetic oligonucleotide
  Target: SOD1; (-) strand; PAM type: YTN; PAM sequence: CTA
tggacattttgggccagaca

SEQ ID NO: 12060 - DNA, 20 bp, Artificial Sequence
  Description of Artificial Sequence: Synthetic oligonucleotide
  Target: SOD1; (-) strand; PAM type: YTN; PAM sequence: CTA
atgcagggcatcgaatgtgg

SEQ ID NO: 12061 - DNA, 20 bp, Artificial Sequence
  Description of Artificial Sequence: Synthetic oligonucleotide
  Target: SOD1; (-) strand; PAM type: YTN; PAM sequence: TTC
ctaatgcagggcatcgaatg

SEQ ID NO: 12062 - DNA, 20 bp, Artificial Sequence
  Description of Artificial Sequence: Synthetic oligonucleotide
  Target: SOD1; (-) strand; PAM type: YTN; PAM sequence: CTT
cctaatgcagggcatcgaat

SEQ ID NO: 12063 - DNA, 20 bp, Artificial Sequence
  Description of Artificial Sequence: Synthetic oligonucleotide
  Target: SOD1; (-) strand; PAM type: YTN; PAM sequence: TTA
tatcttcctaatgcagggca

SEQ ID NO: 12064 - DNA, 20 bp, Artificial Sequence
  Description of Artificial Sequence: Synthetic oligonucleotide
  Target: SOD1; (-) strand; PAM type: YTN; PAM sequence: TTT
atatcttcctaatgcagggc

SEQ ID NO: 12065 - DNA, 20 bp, Artificial Sequence
  Description of Artificial Sequence: Synthetic oligonucleotide
  Target: SOD1; (-) strand; PAM type: YTN; PAM sequence: TTA
agagtatttatatcttccta

SEQ ID NO: 12066 - DNA, 20 bp, Artificial Sequence
  Description of Artificial Sequence: Synthetic oligonucleotide
  Target: SOD1; (-) strand; PAM type: YTN; PAM sequence: TTT
aagagtatttatatcttcct

SEQ ID NO: 12067 - DNA, 20 bp, Artificial Sequence
  Description of Artificial Sequence: Synthetic oligonucleotide
  Target: SOD1; (-) strand; PAM type: YTN; PAM sequence: CTG
tgatatttaagagtatttat

SEQ ID NO: 12068 - DNA, 20 bp, Artificial Sequence
  Description of Artificial Sequence: Synthetic oligonucleotide
  Target: SOD1; (-) strand; PAM type: YTN; PAM sequence: CTC
tgtgatatttaagagtattt

SEQ ID NO: 12069 - DNA, 20 bp, Artificial Sequence
  Description of Artificial Sequence: Synthetic oligonucleotide
  Target: SOD1; (-) strand; PAM type: YTN; PAM sequence: TTA
actctgtgatatttaagagt

SEQ ID NO: 12070 - DNA, 20 bp, Artificial Sequence
  Description of Artificial Sequence: Synthetic oligonucleotide
  Target: SOD1; (-) strand; PAM type: YTN; PAM sequence: TTT
aactctgtgatatttaagag

SEQ ID NO: 12071 - DNA, 20 bp, Artificial Sequence
  Description of Artificial Sequence: Synthetic oligonucleotide
  Target: SOD1; (-) strand; PAM type: YTN; PAM sequence: CTA
gaacaggggtaaggaattta

SEQ ID NO: 12072 - DNA, 20 bp, Artificial Sequence
  Description of Artificial Sequence: Synthetic oligonucleotide
  Target: SOD1; (-) strand; PAM type: YTN; PAM sequence: CTG
ctagaacaggggtaaggaat

SEQ ID NO: 12073 - DNA, 20 bp, Artificial Sequence
  Description of Artificial Sequence: Synthetic oligonucleotide
  Target: SOD1; (-) strand; PAM type: YTN; PAM sequence: CTC
tgctagaacaggggtaagga

SEQ ID NO: 12074 - DNA, 20 bp, Artificial Sequence
  Description of Artificial Sequence: Synthetic oligonucleotide
  Target: SOD1; (-) strand; PAM type: YTN; PAM sequence: CTC
cccccgcaagaatatcatct

SEQ ID NO: 12075 - DNA, 20 bp, Artificial Sequence
  Description of Artificial Sequence: Synthetic oligonucleotide
  Target: SOD1; (-) strand; PAM type: YTN; PAM sequence: TTG
aagccaagaagatgctcccc

SEQ ID NO: 12076 - DNA, 20 bp, Artificial Sequence
  Description of Artificial Sequence: Synthetic oligonucleotide
  Target: SOD1; (-) strand; PAM type: YTN; PAM sequence: CTC
ccatggagaaaagaatgtgt

SEQ ID NO: 12077 - DNA, 20 bp, Artificial Sequence
  Description of Artificial Sequence: Synthetic oligonucleotide
  Target: SOD1; (-) strand; PAM type: YTN; PAM sequence: CTG
gcatcatctcccatggagaa

SEQ ID NO: 12078 - DNA, 20 bp, Artificial Sequence
  Description of Artificial Sequence: Synthetic oligonucleotide
  Target: SOD1; (-) strand; PAM type: YTN; PAM sequence: TTC
tggcatcatctcccatggag

SEQ ID NO: 12079 - DNA, 20 bp, Artificial Sequence
  Description of Artificial Sequence: Synthetic oligonucleotide
  Target: SOD1; (-) strand; PAM type: YTN; PAM sequence: CTT
ctggcatcatctcccatgga

SEQ ID NO: 12080 - DNA, 20 bp, Artificial Sequence
  Description of Artificial Sequence: Synthetic oligonucleotide
  Target: SOD1; (-) strand; PAM type: YTN; PAM sequence: CTC
ttctggcatcatctcccatg

SEQ ID NO: 12081 - DNA, 20 bp, Artificial Sequence
  Description of Artificial Sequence: Synthetic oligonucleotide
  Target: SOD1; (-) strand; PAM type: YTN; PAM sequence: CTG
tccctcttctggcatcatct

SEQ ID NO: 12082 - DNA, 20 bp, Artificial Sequence
  Description of Artificial Sequence: Synthetic oligonucleotide
  Target: SOD1; (-) strand; PAM type: YTN; PAM sequence: TTC
tgtccctcttctggcatcat

SEQ ID NO: 12083 - DNA, 20 bp, Artificial Sequence
  Description of Artificial Sequence: Synthetic oligonucleotide
  Target: SOD1; (-) strand; PAM type: YTN; PAM sequence: CTG
ttctgtccctcttctggcat

SEQ ID NO: 12084 - DNA, 20 bp, Artificial Sequence
  Description of Artificial Sequence: Synthetic oligonucleotide
  Target: SOD1; (-) strand; PAM type: YTN; PAM sequence: CTG
ggccctgttctgtccctctt

SEQ ID NO: 12085 - DNA, 20 bp, Artificial Sequence
  Description of Artificial Sequence: Synthetic oligonucleotide
  Target: SOD1; (-) strand; PAM type: YTN; PAM sequence: TTA
ctgggccctgttctgtccct

SEQ ID NO: 12086 - DNA, 20 bp, Artificial Sequence
  Description of Artificial Sequence: Synthetic oligonucleotide
  Target: SOD1; (-) strand; PAM type: YTN; PAM sequence: TTT
actgggccctgttctgtccc

SEQ ID NO: 12087 - DNA, 20 bp, Artificial Sequence
  Description of Artificial Sequence: Synthetic oligonucleotide
  Target: SOD1; (-) strand; PAM type: YTN; PAM sequence: CTT
tactgggccctgttctgtcc

SEQ ID NO: 12088 - DNA, 20 bp, Artificial Sequence
  Description of Artificial Sequence: Synthetic oligonucleotide
  Target: SOD1; (-) strand; PAM type: YTN; PAM sequence: CTG
gccccaggccccatgcttta

SEQ ID NO: 12089 - DNA, 20 bp, Artificial Sequence
  Description of Artificial Sequence: Synthetic oligonucleotide
  Target: SOD1; (-) strand; PAM type: YTN; PAM sequence: CTG
aacaagggggtccctggccc

SEQ ID NO: 12090 - DNA, 20 bp, Artificial Sequence
  Description of Artificial Sequence: Synthetic oligonucleotide
  Target: SOD1; (-) strand; PAM type: YTN; PAM sequence: TTC
gtaggatggtcgtcacacct

SEQ ID NO: 12091 - DNA, 20 bp, Artificial Sequence
  Description of Artificial Sequence: Synthetic oligonucleotide
  Target: SOD1; (-) strand; PAM type: YTN; PAM sequence: CTT
cgtaggatggtcgtcacacc

SEQ ID NO: 12092 - DNA, 20 bp, Artificial Sequence
  Description of Artificial Sequence: Synthetic oligonucleotide
  Target: SOD1; (-) strand; PAM type: YTN; PAM sequence: CTG
ggtggtgccttcgtaggatg

SEQ ID NO: 12093 - DNA, 20 bp, Artificial Sequence
  Description of Artificial Sequence: Synthetic oligonucleotide
  Target: SOD1; (-) strand; PAM type: YTN; PAM sequence: CTA
atgatgcctgggtggtgcct

SEQ ID NO: 12094 - DNA, 20 bp, Artificial Sequence
  Description of Artificial Sequence: Synthetic oligonucleotide
  Target: SOD1; (-) strand; PAM type: YTN; PAM sequence: TTG
agacggtctaatgatgcctg

SEQ ID NO: 12095 - DNA, 20 bp, Artificial Sequence
  Description of Artificial Sequence: Synthetic oligonucleotide
  Target: SOD1; (-) strand; PAM type: YTN; PAM sequence: TTT
gagacggtctaatgatgcct

SEQ ID NO: 12096 - DNA, 20 bp, Artificial Sequence
  Description of Artificial Sequence: Synthetic oligonucleotide
  Target: SOD1; (-) strand; PAM type: YTN; PAM sequence: TTT
tgagacggtctaatgatgcc

SEQ ID NO: 12097 - DNA, 20 bp, Artificial Sequence
  Description of Artificial Sequence: Synthetic oligonucleotide
  Target: SOD1; (-) strand; PAM type: YTN; PAM sequence: CTT
ttgagacggtctaatgatgc

SEQ ID NO: 12098 - DNA, 20 bp, Artificial Sequence
  Description of Artificial Sequence: Synthetic oligonucleotide
  Target: SOD1; (-) strand; PAM type: YTN; PAM sequence: TTC
ttttgagacggtctaatgat

SEQ ID NO: 12099 - DNA, 20 bp, Artificial Sequence
  Description of Artificial Sequence: Synthetic oligonucleotide
  Target: SOD1; (-) strand; PAM type: YTN; PAM sequence: CTT
cttttgagacggtctaatga

SEQ ID NO: 12100 - DNA, 20 bp, Artificial Sequence
  Description of Artificial Sequence: Synthetic oligonucleotide
  Target: SOD1; (-) strand; PAM type: YTN; PAM sequence: CTC
ttcttttgagacggtctaat

SEQ ID NO: 12101 - DNA, 20 bp, Artificial Sequence
  Description of Artificial Sequence: Synthetic oligonucleotide
  Target: SOD1; (-) strand; PAM type: YTN; PAM sequence: TTA
ctcttcttttgagacggtct

SEQ ID NO: 12102 - DNA, 20 bp, Artificial Sequence
  Description of Artificial Sequence: Synthetic oligonucleotide
  Target: SOD1; (-) strand; PAM type: YTN; PAM sequence: TTG
ggacagtgaattactcttct

SEQ ID NO: 12103 - DNA, 20 bp, Artificial Sequence
  Description of Artificial Sequence: Synthetic oligonucleotide
  Target: SOD1; (-) strand; PAM type: YTN; PAM sequence: TTT
gggacagtgaattactcttc

SEQ ID NO: 12104 - DNA, 20 bp, Artificial Sequence
  Description of Artificial Sequence: Synthetic oligonucleotide
  Target: SOD1; (-) strand; PAM type: YTN; PAM sequence: CTT
tgggacagtgaattactctt

SEQ ID NO: 12105 - DNA, 20 bp, Artificial Sequence
  Description of Artificial Sequence: Synthetic oligonucleotide
  Target: SOD1; (-) strand; PAM type: YTN; PAM sequence: CTG
ctttgggacagtgaattact

SEQ ID NO: 12106 - DNA, 20 bp, Artificial Sequence
  Description of Artificial Sequence: Synthetic oligonucleotide
  Target: SOD1; (-) strand; PAM type: YTN; PAM sequence: TTG
ccaagggatccgcccacaga

SEQ ID NO: 12107 - DNA, 20 bp, Artificial Sequence
  Description of Artificial Sequence: Synthetic oligonucleotide
  Target: SOD1; (-) strand; PAM type: YTN; PAM sequence: CTT
gccaagggatccgcccacag

SEQ ID NO: 12108 - DNA, 20 bp, Artificial Sequence
  Description of Artificial Sequence: Synthetic oligonucleotide
  Target: SOD1; (-) strand; PAM type: YTN; PAM sequence: TTG
taaacttgccaagggatccg

SEQ ID NO: 12109 - DNA, 20 bp, Artificial Sequence
  Description of Artificial Sequence: Synthetic oligonucleotide
  Target: SOD1; (-) strand; PAM type: YTN; PAM sequence: TTC
attgtaaacttgccaaggga

SEQ ID NO: 12110 - DNA, 20 bp, Artificial Sequence
  Description of Artificial Sequence: Synthetic oligonucleotide
  Target: SOD1; (-) strand; PAM type: YTN; PAM sequence: TTC
agttcattgtaaacttgcca

SEQ ID NO: 12111 - DNA, 20 bp, Artificial Sequence
  Description of Artificial Sequence: Synthetic oligonucleotide
  Target: SOD1; (-) strand; PAM type: YTN; PAM sequence: TTT
cagttcattgtaaacttgcc

SEQ ID NO: 12112 - DNA, 20 bp, Artificial Sequence
  Description of Artificial Sequence: Synthetic oligonucleotide
  Target: SOD1; (-) strand; PAM type: YTN; PAM sequence: TTC
ggcagatttcagttcattgt

SEQ ID NO: 12113 - DNA, 20 bp, Artificial Sequence
  Description of Artificial Sequence: Synthetic oligonucleotide
  Target: SOD1; (-) strand; PAM type: YTN; PAM sequence: TTC
caggaagttcggcagatttc

SEQ ID NO: 12114 - DNA, 20 bp, Artificial Sequence
  Description of Artificial Sequence: Synthetic oligonucleotide
  Target: SOD1; (-) strand; PAM type: YTN; PAM sequence: TTG
ggttccaggaagttcggcag

SEQ ID NO: 12115 - DNA, 20 bp, Artificial Sequence
  Description of Artificial Sequence: Synthetic oligonucleotide
  Target: SOD1; (-) strand; PAM type: YTN; PAM sequence: TTT
gggttccaggaagttcggca

SEQ ID NO: 12116 - DNA, 20 bp, Artificial Sequence
  Description of Artificial Sequence: Synthetic oligonucleotide
  Target: SOD1; (-) strand; PAM type: YTN; PAM sequence: CTT
tgggttccaggaagttcggc

SEQ ID NO: 12117 - DNA, 20 bp, Artificial Sequence
  Description of Artificial Sequence: Synthetic oligonucleotide
  Target: SOD1; (-) strand; PAM type: YTN; PAM sequence: TTC
tttgggttccaggaagttcg

SEQ ID NO: 12118 - DNA, 20 bp, Artificial Sequence
  Description of Artificial Sequence: Synthetic oligonucleotide
  Target: SOD1; (-) strand; PAM type: YTN; PAM sequence: TTT
ctttgggttccaggaagttc

SEQ ID NO: 12119 - DNA, 20 bp, Artificial Sequence
  Description of Artificial Sequence: Synthetic oligonucleotide
  Target: SOD1; (-) strand; PAM type: YTN; PAM sequence: CTA
aagtttctttgggttccagg

SEQ ID NO: 12120 - DNA, 20 bp, Artificial Sequence
  Description of Artificial Sequence: Synthetic oligonucleotide
  Target: SOD1; (-) strand; PAM type: YTN; PAM sequence: TTG
cccaaggctaaagtttcttt

SEQ ID NO: 12121 - DNA, 20 bp, Artificial Sequence
  Description of Artificial Sequence: Synthetic oligonucleotide
  Target: SOD1; (-) strand; PAM type: YTN; PAM sequence: TTT
gcccaaggctaaagtttctt

SEQ ID NO: 12122 - DNA, 20 bp, Artificial Sequence
  Description of Artificial Sequence: Synthetic oligonucleotide
  Target: SOD1; (-) strand; PAM type: YTN; PAM sequence: CTT
tgcccaaggctaaagtttct

SEQ ID NO: 12123 - DNA, 20 bp, Artificial Sequence
  Description of Artificial Sequence: Synthetic oligonucleotide
  Target: SOD1; (-) strand; PAM type: YTN; PAM sequence: CTG
gccaaagggcctttgcccaa

SEQ ID NO: 12124 - DNA, 20 bp, Artificial Sequence
  Description of Artificial Sequence: Synthetic oligonucleotide
  Target: SOD1; (-) strand; PAM type: YTN; PAM sequence: TTG
cataaacagtgcaaatgctg

SEQ ID NO: 12125 - DNA, 20 bp, Artificial Sequence
  Description of Artificial Sequence: Synthetic oligonucleotide
  Target: SOD1; (-) strand; PAM type: YTN; PAM sequence: CTA
aacggttgcataaacagtgc

SEQ ID NO: 12126 - DNA, 20 bp, Artificial Sequence
  Description of Artificial Sequence: Synthetic oligonucleotide
  Target: SOD1; (-) strand; PAM type: YTN; PAM sequence: TTC
taaacggttgcataaacagt

SEQ ID NO: 12127 - DNA, 20 bp, Artificial Sequence
  Description of Artificial Sequence: Synthetic oligonucleotide
  Target: SOD1; (-) strand; PAM type: YTN; PAM sequence: TTC
gtatattctaaacggttgca

SEQ ID NO: 12128 - DNA, 20 bp, Artificial Sequence
  Description of Artificial Sequence: Synthetic oligonucleotide
  Target: SOD1; (-) strand; PAM type: YTN; PAM sequence: CTC
cagataattcgtatattcta

SEQ ID NO: 12129 - DNA, 20 bp, Artificial Sequence
  Description of Artificial Sequence: Synthetic oligonucleotide
  Target: SOD1; (-) strand; PAM type: YTN; PAM sequence: TTG
gtagtagtctccagataatt

SEQ ID NO: 12130 - DNA, 20 bp, Artificial Sequence
  Description of Artificial Sequence: Synthetic oligonucleotide
  Target: SOD1; (-) strand; PAM type: YTN; PAM sequence: TTT
ggtagtagtctccagataat

SEQ ID NO: 12131 - DNA, 20 bp, Artificial Sequence
  Description of Artificial Sequence: Synthetic oligonucleotide
  Target: SOD1; (-) strand; PAM type: YTN; PAM sequence: TTG
tatttggtagtagtctccag

SEQ ID NO: 12132 - DNA, 20 bp, Artificial Sequence
  Description of Artificial Sequence: Synthetic oligonucleotide
  Target: SOD1; (-) strand; PAM type: YTN; PAM sequence: CTG
ttgtatttggtagtagtctc

SEQ ID NO: 12133 - DNA, 20 bp, Artificial Sequence
  Description of Artificial Sequence: Synthetic oligonucleotide
  Target: SOD1; (-) strand; PAM type: YTN; PAM sequence: TTG
cctgttgtatttggtagtag

SEQ ID NO: 12134 - DNA, 20 bp, Artificial Sequence
  Description of Artificial Sequence: Synthetic oligonucleotide
  Target: SOD1; (-) strand; PAM type: YTN; PAM sequence: TTT
gcctgttgtatttggtagta

SEQ ID NO: 12135 - DNA, 20 bp, Artificial Sequence
  Description of Artificial Sequence: Synthetic oligonucleotide
  Target: SOD1; (-) strand; PAM type: YTN; PAM sequence: TTT
tgcctgttgtatttggtagt

SEQ ID NO: 12136 - DNA, 20 bp, Artificial Sequence
  Description of Artificial Sequence: Synthetic oligonucleotide
  Target: SOD1; (-) strand; PAM type: YTN; PAM sequence: TTG
cagttttgcctgttgtattt

SEQ ID NO: 12137 - DNA, 20 bp, Artificial Sequence
  Description of Artificial Sequence: Synthetic oligonucleotide
  Target: SOD1; (-) strand; PAM type: YTN; PAM sequence: TTT
gcagttttgcctgttgtatt

SEQ ID NO: 12138 - DNA, 20 bp, Artificial Sequence
  Description of Artificial Sequence: Synthetic oligonucleotide
  Target: SOD1; (-) strand; PAM type: YTN; PAM sequence: CTA
ggaagtatacatatttgcag

SEQ ID NO: 12139 - DNA, 20 bp, Artificial Sequence
  Description of Artificial Sequence: Synthetic oligonucleotide
  Target: SOD1; (-) strand; PAM type: YTN; PAM sequence: CTC
taggaagtatacatatttgc

SEQ ID NO: 12140 - DNA, 20 bp, Artificial Sequence
  Description of Artificial Sequence: Synthetic oligonucleotide
  Target: SOD1; (-) strand; PAM type: YTN; PAM sequence: TTA
tcatcctctaggaagtatac

SEQ ID NO: 12141 - DNA, 20 bp, Artificial Sequence
  Description of Artificial Sequence: Synthetic oligonucleotide
  Target: SOD1; (-) strand; PAM type: YTN; PAM sequence: TTT
atcatcctctaggaagtata

SEQ ID NO: 12142 - DNA, 20 bp, Artificial Sequence
  Description of Artificial Sequence: Synthetic oligonucleotide
  Target: SOD1; (-) strand; PAM type: YTN; PAM sequence: TTT
tatcatcctctaggaagtat

SEQ ID NO: 12143 - DNA, 20 bp, Artificial Sequence
  Description of Artificial Sequence: Synthetic oligonucleotide
  Target: SOD1; (-) strand; PAM type: YTN; PAM sequence: TTT
ttatcatcctctaggaagta

SEQ ID NO: 12144 - DNA, 20 bp, Artificial Sequence
  Description of Artificial Sequence: Synthetic oligonucleotide
  Target: SOD1; (-) strand; PAM type: YTN; PAM sequence: TTT
tttatcatcctctaggaagt

SEQ ID NO: 12145 - DNA, 20 bp, Artificial Sequence
  Description of Artificial Sequence: Synthetic oligonucleotide
  Target: SOD1; (-) strand; PAM type: YTN; PAM sequence: TTT
ttttatcatcctctaggaag

SEQ ID NO: 12146 - DNA, 20 bp, Artificial Sequence
  Description of Artificial Sequence: Synthetic oligonucleotide
  Target: SOD1; (-) strand; PAM type: YTN; PAM sequence: TTC
acatttttttatcatcctct

SEQ ID NO: 12147 - DNA, 20 bp, Artificial Sequence
  Description of Artificial Sequence: Synthetic oligonucleotide
  Target: SOD1; (-) strand; PAM type: YTN; PAM sequence: CTA
tcagagaaatacaattcaca

SEQ ID NO: 12148 - DNA, 20 bp, Artificial Sequence
  Description of Artificial Sequence: Synthetic oligonucleotide
  Target: SOD1; (-) strand; PAM type: YTN; PAM sequence: CTC
tatcagagaaatacaattca

SEQ ID NO: 12149 - DNA, 20 bp, Artificial Sequence
  Description of Artificial Sequence: Synthetic oligonucleotide
  Target: SOD1; (-) strand; PAM type: YTN; PAM sequence: CTA
atgcatcctctatcagagaa

SEQ ID NO: 12150 - DNA, 20 bp, Artificial Sequence
  Description of Artificial Sequence: Synthetic oligonucleotide
  Target: SOD1; (-) strand; PAM type: YTN; PAM sequence: CTC
taatgcatcctctatcagag

SEQ ID NO: 12151 - DNA, 20 bp, Artificial Sequence
  Description of Artificial Sequence: Synthetic oligonucleotide
  Target: SOD1; (-) strand; PAM type: YTN; PAM sequence: CTC
agactctaatgcatcctcta

SEQ ID NO: 12152 - DNA, 20 bp, Artificial Sequence
  Description of Artificial Sequence: Synthetic oligonucleotide
  Target: SOD1; (-) strand; PAM type: YTN; PAM sequence: TTA
gaccctcagactctaatgca

SEQ ID NO: 12153 - DNA, 20 bp, Artificial Sequence
  Description of Artificial Sequence: Synthetic oligonucleotide
  Target: SOD1; (-) strand; PAM type: YTN; PAM sequence: TTT
agaccctcagactctaatgc

SEQ ID NO: 12154 - DNA, 20 bp, Artificial Sequence
  Description of Artificial Sequence: Synthetic oligonucleotide
  Target: SOD1; (-) strand; PAM type: YTN; PAM sequence: CTA
tttagaccctcagactctaa

SEQ ID NO: 12155 - DNA, 20 bp, Artificial Sequence
  Description of Artificial Sequence: Synthetic oligonucleotide
  Target: SOD1; (-) strand; PAM type: YTN; PAM sequence: TTA
cgctatttagaccctcagac

SEQ ID NO: 12156 - DNA, 20 bp, Artificial Sequence
  Description of Artificial Sequence: Synthetic oligonucleotide
  Target: SOD1; (-) strand; PAM type: YTN; PAM sequence: TTT
acgctatttagaccctcaga

SEQ ID NO: 12157 - DNA, 20 bp, Artificial Sequence
  Description of Artificial Sequence: Synthetic oligonucleotide
  Target: SOD1; (-) strand; PAM type: YTN; PAM sequence: TTA
tttacgctatttagaccctc

SEQ ID NO: 12158 - DNA, 20 bp, Artificial Sequence
  Description of Artificial Sequence: Synthetic oligonucleotide
  Target: SOD1; (-) strand; PAM type: YTN; PAM sequence: TTA
ttatttacgctatttagacc

SEQ ID NO: 12159 - DNA, 20 bp, Artificial Sequence
  Description of Artificial Sequence: Synthetic oligonucleotide
  Target: SOD1; (-) strand; PAM type: YTN; PAM sequence: TTT
attatttacgctatttagac

SEQ ID NO: 12160 - DNA, 20 bp, Artificial Sequence
  Description of Artificial Sequence: Synthetic oligonucleotide
  Target: SOD1; (-) strand; PAM type: YTN; PAM sequence: TTA
tttattatttacgctattta

SEQ ID NO: 12161 - DNA, 20 bp, Artificial Sequence
  Description of Artificial Sequence: Synthetic oligonucleotide
  Target: SOD1; (-) strand; PAM type: YTN; PAM sequence: CTT
atttattatttacgctattt

SEQ ID NO: 12162 - DNA, 20 bp, Artificial Sequence
  Description of Artificial Sequence: Synthetic oligonucleotide
  Target: SOD1; (-) strand; PAM type: YTN; PAM sequence: TTA
cttatttattatttacgcta

SEQ ID NO: 12163 - DNA, 20 bp, Artificial Sequence
  Description of Artificial Sequence: Synthetic oligonucleotide
  Target: SOD1; (-) strand; PAM type: YTN; PAM sequence: TTT
acttatttattatttacgct

SEQ ID NO: 12164 - DNA, 20 bp, Artificial Sequence
  Description of Artificial Sequence: Synthetic oligonucleotide
  Target: SOD1; (-) strand; PAM type: YTN; PAM sequence: TTA
tttacttatttattatttac

SEQ ID NO: 12165 - DNA, 20 bp, Artificial Sequence
  Description of Artificial Sequence: Synthetic oligonucleotide
  Target: SOD1; (-) strand; PAM type: YTN; PAM sequence: TTT
atttacttatttattattta

SEQ ID NO: 12166 - DNA, 20 bp, Artificial Sequence
  Description of Artificial Sequence: Synthetic oligonucleotide
  Target: SOD1; (-) strand; PAM type: YTN; PAM sequence: CTA
tcgatttatttacttattta

SEQ ID NO: 12167 - DNA, 20 bp, Artificial Sequence
  Description of Artificial Sequence: Synthetic oligonucleotide
  Target: SOD1; (-) strand; PAM type: YTN; PAM sequence: CTA
ctatcgatttatttacttat

SEQ ID NO: 12168 - DNA, 20 bp, Artificial Sequence
  Description of Artificial Sequence: Synthetic oligonucleotide
  Target: SOD1; (-) strand; PAM type: YTN; PAM sequence: TTG
gagtacactactatcgattt

SEQ ID NO: 12169 - DNA, 20 bp, Artificial Sequence
  Description of Artificial Sequence: Synthetic oligonucleotide
  Target: SOD1; (-) strand; PAM type: YTN; PAM sequence: TTT
ggagtacactactatcgatt

SEQ ID NO: 12170 - DNA, 20 bp, Artificial Sequence
  Description of Artificial Sequence: Synthetic oligonucleotide
  Target: SOD1; (-) strand; PAM type: YTN; PAM sequence: CTC
gtttggagtacactactatc

SEQ ID NO: 12171 - DNA, 20 bp, Artificial Sequence
  Description of Artificial Sequence: Synthetic oligonucleotide
  Target: SOD1; (-) strand; PAM type: YTN; PAM sequence: TTC
cagcctcgtttggagtacac

SEQ ID NO: 12172 - DNA, 20 bp, Artificial Sequence
  Description of Artificial Sequence: Synthetic oligonucleotide
  Target: SOD1; (-) strand; PAM type: YTN; PAM sequence: CTA
ttccagcctcgtttggagta

SEQ ID NO: 12173 - DNA, 20 bp, Artificial Sequence
  Description of Artificial Sequence: Synthetic oligonucleotide
  Target: SOD1; (-) strand; PAM type: YTN; PAM sequence: TTG
aagtccagtgtgaaacaaca

SEQ ID NO: 12174 - DNA, 20 bp, Artificial Sequence
  Description of Artificial Sequence: Synthetic oligonucleotide
  Target: SOD1; (-) strand; PAM type: YTN; PAM sequence: TTA
attgaagtccagtgtgaaac

SEQ ID NO: 12175 - DNA, 20 bp, Artificial Sequence
  Description of Artificial Sequence: Synthetic oligonucleotide
  Target: SOD1; (-) strand; PAM type: YTN; PAM sequence: CTT
aattgaagtccagtgtgaaa

SEQ ID NO: 12176 - DNA, 20 bp, Artificial Sequence
  Description of Artificial Sequence: Synthetic oligonucleotide
  Target: SOD1; (-) strand; PAM type: YTN; PAM sequence: CTG
agacttaattgaagtccagt

SEQ ID NO: 12177 - DNA, 20 bp, Artificial Sequence
  Description of Artificial Sequence: Synthetic oligonucleotide
  Target: SOD1; (-) strand; PAM type: YTN; PAM sequence: TTG
agtatggcaaaatactgaga

SEQ ID NO: 12178 - DNA, 20 bp, Artificial Sequence
  Description of Artificial Sequence: Synthetic oligonucleotide
  Target: SOD1; (-) strand; PAM type: YTN; PAM sequence: TTA
atattgagtatggcaaaata

SEQ ID NO: 12179 - DNA, 20 bp, Artificial Sequence
  Description of Artificial Sequence: Synthetic oligonucleotide
  Target: SOD1; (-) strand; PAM type: YTN; PAM sequence: CTT
aatattgagtatggcaaaat

SEQ ID NO: 12180 - DNA, 20 bp, Artificial Sequence
  Description of Artificial Sequence: Synthetic oligonucleotide
  Target: SOD1; (-) strand; PAM type: YTN; PAM sequence: CTA
gtacttaatattgagtatgg

SEQ ID NO: 12181 - DNA, 20 bp, Artificial Sequence
  Description of Artificial Sequence: Synthetic oligonucleotide
  Target: SOD1; (-) strand; PAM type: YTN; PAM sequence: TTA
cagacatgagccaccacgtc

SEQ ID NO: 12182 - DNA, 20 bp, Artificial Sequence
  Description of Artificial Sequence: Synthetic oligonucleotide
  Target: SOD1; (-) strand; PAM type: YTN; PAM sequence: CTG
ggattacagacatgagccac

SEQ ID NO: 12183 - DNA, 20 bp, Artificial Sequence
  Description of Artificial Sequence: Synthetic oligonucleotide
  Target: SOD1; (-) strand; PAM type: YTN; PAM sequence: CTC
ccaaagtgctgggattacag

SEQ ID NO: 12184 - DNA, 20 bp, Artificial Sequence
  Description of Artificial Sequence: Synthetic oligonucleotide
  Target: SOD1; (-) strand; PAM type: YTN; PAM sequence: CTC
ggcctcccaaagtgctggga

SEQ ID NO: 12185 - DNA, 20 bp, Artificial Sequence
  Description of Artificial Sequence: Synthetic oligonucleotide
  Target: SOD1; (-) strand; PAM type: YTN; PAM sequence: CTA
cccacctcggcctcccaaag

SEQ ID NO: 12186 - DNA, 20 bp, Artificial Sequence
  Description of Artificial Sequence: Synthetic oligonucleotide
  Target: SOD1; (-) strand; PAM type: YTN; PAM sequence: CTC
aagccagccatctacccacc

SEQ ID NO: 12187 - DNA, 20 bp, Artificial Sequence
  Description of Artificial Sequence: Synthetic oligonucleotide
  Target: SOD1; (-) strand; PAM type: YTN; PAM sequence: CTG
agctcaagccagccatctac

SEQ ID NO: 12188 - DNA, 20 bp, Artificial Sequence
  Description of Artificial Sequence: Synthetic oligonucleotide
  Target: SOD1; (-) strand; PAM type: YTN; PAM sequence: CTC
ctgagctcaagccagccatc

SEQ ID NO: 12189 - DNA, 20 bp, Artificial Sequence
  Description of Artificial Sequence: Synthetic oligonucleotide
  Target: SOD1; (-) strand; PAM type: YTN; PAM sequence: TTC
aaactcctgagctcaagcca

SEQ ID NO: 12190 - DNA, 20 bp, Artificial Sequence
  Description of Artificial Sequence: Synthetic oligonucleotide
  Target: SOD1; (-) strand; PAM type: YTN; PAM sequence: TTT
caaactcctgagctcaagcc

SEQ ID NO: 12191 - DNA, 20 bp, Artificial Sequence
  Description of Artificial Sequence: Synthetic oligonucleotide
  Target: SOD1; (-) strand; PAM type: YTN; PAM sequence: CTG
gtttcaaactcctgagctca

SEQ ID NO: 12192 - DNA, 20 bp, Artificial Sequence
  Description of Artificial Sequence: Synthetic oligonucleotide
  Target: SOD1; (-) strand; PAM type: YTN; PAM sequence: TTG
cccaggctggtttcaaactc

SEQ ID NO: 12193 - DNA, 20 bp, Artificial Sequence
  Description of Artificial Sequence: Synthetic oligonucleotide
  Target: SOD1; (-) strand; PAM type: YTN; PAM sequence: TTA
ccatgttgcccaggctggtt

SEQ ID NO: 12194 - DNA, 20 bp, Artificial Sequence
  Description of Artificial Sequence: Synthetic oligonucleotide
  Target: SOD1; (-) strand; PAM type: YTN; PAM sequence: TTT
accatgttgcccaggctggt

SEQ ID NO: 12195 - DNA, 20 bp, Artificial Sequence
  Description of Artificial Sequence: Synthetic oligonucleotide
  Target: SOD1; (-) strand; PAM type: YTN; PAM sequence: TTT
taccatgttgcccaggctgg

SEQ ID NO: 12196 - DNA, 20 bp, Artificial Sequence
  Description of Artificial Sequence: Synthetic oligonucleotide
  Target: SOD1; (-) strand; PAM type: YTN; PAM sequence: TTG
ggtacagatggggttttacc

SEQ ID NO: 12197 - DNA, 20 bp, Artificial Sequence
  Description of Artificial Sequence: Synthetic oligonucleotide
  Target: SOD1; (-) strand; PAM type: YTN; PAM sequence: TTT
gggtacagatggggttttac

SEQ ID NO: 12198 - DNA, 20 bp, Artificial Sequence
  Description of Artificial Sequence: Synthetic oligonucleotide
  Target: SOD1; (-) strand; PAM type: YTN; PAM sequence: TTT
tgggtacagatggggtttta

SEQ ID NO: 12199 - DNA, 20 bp, Artificial Sequence
  Description of Artificial Sequence: Synthetic oligonucleotide
  Target: SOD1; (-) strand; PAM type: YTN; PAM sequence: TTG
tattttgggtacagatgggg

SEQ ID NO: 12200 - DNA, 20 bp, Artificial Sequence
  Description of Artificial Sequence: Synthetic oligonucleotide
  Target: SOD1; (-) strand; PAM type: YTN; PAM sequence: TTT
gtattttgggtacagatggg

SEQ ID NO: 12201 - DNA, 20 bp, Artificial Sequence
  Description of Artificial Sequence: Synthetic oligonucleotide
  Target: SOD1; (-) strand; PAM type: YTN; PAM sequence: TTT
tgtattttgggtacagatgg

SEQ ID NO: 12202 - DNA, 20 bp, Artificial Sequence
  Description of Artificial Sequence: Synthetic oligonucleotide
  Target: SOD1; (-) strand; PAM type: YTN; PAM sequence: TTT
ttgtattttgggtacagatg

SEQ ID NO: 12203 - DNA, 20 bp, Artificial Sequence
  Description of Artificial Sequence: Synthetic oligonucleotide
  Target: SOD1; (-) strand; PAM type: YTN; PAM sequence: CTG
atttttgtattttgggtaca

SEQ ID NO: 12204 - DNA, 20 bp, Artificial Sequence
  Description of Artificial Sequence: Synthetic oligonucleotide
  Target: SOD1; (-) strand; PAM type: YTN; PAM sequence: CTG
gctgatttttgtattttggg

SEQ ID NO: 12205 - DNA, 20 bp, Artificial Sequence
  Description of Artificial Sequence: Synthetic oligonucleotide
  Target: SOD1; (-) strand; PAM type: YTN; PAM sequence: CTG
ggaccacaggcatgtgccac

SEQ ID NO: 12206 - DNA, 20 bp, Artificial Sequence
  Description of Artificial Sequence: Synthetic oligonucleotide
  Target: SOD1; (-) strand; PAM type: YTN; PAM sequence: CTC
ccaagtacctgggaccacag

SEQ ID NO: 12207 - DNA, 20 bp, Artificial Sequence
  Description of Artificial Sequence: Synthetic oligonucleotide
  Target: SOD1; (-) strand; PAM type: YTN; PAM sequence: CTC
agcctcccaagtacctggga

SEQ ID NO: 12208 - DNA, 20 bp, Artificial Sequence
  Description of Artificial Sequence: Synthetic oligonucleotide
  Target: SOD1; (-) strand; PAM type: YTN; PAM sequence: CTG
cctcagcctcccaagtacct

SEQ ID NO: 12209 - DNA, 20 bp, Artificial Sequence
  Description of Artificial Sequence: Synthetic oligonucleotide
  Target: SOD1; (-) strand; PAM type: YTN; PAM sequence: CTC
ctgcctcagcctcccaagta

SEQ ID NO: 12210 - DNA, 20 bp, Artificial Sequence
  Description of Artificial Sequence: Synthetic oligonucleotide
  Target: SOD1; (-) strand; PAM type: YTN; PAM sequence: TTC
aagccatcctcctgcctcag

SEQ ID NO: 12211 - DNA, 20 bp, Artificial Sequence
  Description of Artificial Sequence: Synthetic oligonucleotide
  Target: SOD1; (-) strand; PAM type: YTN; PAM sequence: CTG
ggttcaagccatcctcctgc

SEQ ID NO: 12212 - DNA, 20 bp, Artificial Sequence
  Description of Artificial Sequence: Synthetic oligonucleotide
  Target: SOD1; (-) strand; PAM type: YTN; PAM sequence: CTC
ctgggttcaagccatcctcc

SEQ ID NO: 12213 - DNA, 20 bp, Artificial Sequence
  Description of Artificial Sequence: Synthetic oligonucleotide
  Target: SOD1; (-) strand; PAM type: YTN; PAM sequence: CTC
cacctcctgggttcaagcca

SEQ ID NO: 12214 - DNA, 20 bp, Artificial Sequence
  Description of Artificial Sequence: Synthetic oligonucleotide
  Target: SOD1; (-) strand; PAM type: YTN; PAM sequence: CTG
cagcctccacctcctgggtt

SEQ ID NO: 12215 - DNA, 20 bp, Artificial Sequence
  Description of Artificial Sequence: Synthetic oligonucleotide
  Target: SOD1; (-) strand; PAM type: YTN; PAM sequence: CTC
actgcagcctccacctcctg

SEQ ID NO: 12216 - DNA, 20 bp, Artificial Sequence
  Description of Artificial Sequence: Synthetic oligonucleotide
  Target: SOD1; (-) strand; PAM type: YTN; PAM sequence: CTG
gagtgcagtggcgccatcat

SEQ ID NO: 12217 - DNA, 20 bp, Artificial Sequence
  Description of Artificial Sequence: Synthetic oligonucleotide
  Target: SOD1; (-) strand; PAM type: YTN; PAM sequence: CTG
tcacccaggctggagtgcag

SEQ ID NO: 12218 - DNA, 20 bp, Artificial Sequence
  Description of Artificial Sequence: Synthetic oligonucleotide
  Target: SOD1; (-) strand; PAM type: YTN; PAM sequence: CTC
tgtcacccaggctggagtgc

SEQ ID NO: 12219 - DNA, 20 bp, Artificial Sequence
  Description of Artificial Sequence: Synthetic oligonucleotide
  Target: SOD1; (-) strand; PAM type: YTN; PAM sequence: CTC
gctctgtcacccaggctgga

SEQ ID NO: 12220 - DNA, 20 bp, Artificial Sequence
  Description of Artificial Sequence: Synthetic oligonucleotide
  Target: SOD1; (-) strand; PAM type: YTN; PAM sequence: TTG
agacagggtctcgctctgtc

SEQ ID NO: 12221 - DNA, 20 bp, Artificial Sequence
  Description of Artificial Sequence: Synthetic oligonucleotide
  Target: SOD1; (-) strand; PAM type: YTN; PAM sequence: TTT
gagacagggtctcgctctgt

SEQ ID NO: 12222 - DNA, 20 bp, Artificial Sequence
  Description of Artificial Sequence: Synthetic oligonucleotide
  Target: SOD1; (-) strand; PAM type: YTN; PAM sequence: TTT
tgagacagggtctcgctctg

SEQ ID NO: 12223 - DNA, 20 bp, Artificial Sequence
  Description of Artificial Sequence: Synthetic oligonucleotide
  Target: SOD1; (-) strand; PAM type: YTN; PAM sequence: TTT
ttgagacagggtctcgctct

SEQ ID NO: 12224 - DNA, 20 bp, Artificial Sequence
  Description of Artificial Sequence: Synthetic oligonucleotide
  Target: SOD1; (-) strand; PAM type: YTN; PAM sequence: TTG
atttttgagacagggtctcg

SEQ ID NO: 12225 - DNA, 20 bp, Artificial Sequence
  Description of Artificial Sequence: Synthetic oligonucleotide
  Target: SOD1; (-) strand; PAM type: YTN; PAM sequence: TTT
gatttttgagacagggtctc

SEQ ID NO: 12226 - DNA, 20 bp, Artificial Sequence
  Description of Artificial Sequence: Synthetic oligonucleotide
  Target: SOD1; (-) strand; PAM type: YTN; PAM sequence: TTG
tttgatttttgagacagggt

SEQ ID NO: 12227 - DNA, 20 bp, Artificial Sequence
  Description of Artificial Sequence: Synthetic oligonucleotide
  Target: SOD1; (-) strand; PAM type: YTN; PAM sequence: TTT
gtttgatttttgagacaggg

SEQ ID NO: 12228 - DNA, 20 bp, Artificial Sequence
  Description of Artificial Sequence: Synthetic oligonucleotide
  Target: SOD1; (-) strand; PAM type: YTN; PAM sequence: TTG
tttgtttgatttttgagaca

SEQ ID NO: 12229 - DNA, 20 bp, Artificial Sequence
  Description of Artificial Sequence: Synthetic oligonucleotide
  Target: SOD1; (-) strand; PAM type: YTN; PAM sequence: TTG
tccggggcgagggggttgtt

SEQ ID NO: 12230 - DNA, 20 bp, Artificial Sequence
  Description of Artificial Sequence: Synthetic oligonucleotide
  Target: SOD1; (-) strand; PAM type: YTN; PAM sequence: TTT
gtccggggcgagggggttgt

SEQ ID NO: 12231 - DNA, 20 bp, Artificial Sequence
  Description of Artificial Sequence: Synthetic oligonucleotide
  Target: SOD1; (-) strand; PAM type: YTN; PAM sequence: TTT
tgtccggggcgagggggttg

SEQ ID NO: 12232 - DNA, 20 bp, Artificial Sequence
  Description of Artificial Sequence: Synthetic oligonucleotide
  Target: SOD1; (-) strand; PAM type: YTN; PAM sequence: CTT
ttgtccggggcgagggggtt

SEQ ID NO: 12233 - DNA, 20 bp, Artificial Sequence
  Description of Artificial Sequence: Synthetic oligonucleotide
  Target: SOD1; (-) strand; PAM type: YTN; PAM sequence: CTA
cttttgtccggggcgagggg

SEQ ID NO: 12234 - DNA, 20 bp, Artificial Sequence
  Description of Artificial Sequence: Synthetic oligonucleotide
  Target: SOD1; (-) strand; PAM type: YTN; PAM sequence: TTG
tgaaatgagaaaatagtgca

SEQ ID NO: 12235 - DNA, 20 bp, Artificial Sequence
  Description of Artificial Sequence: Synthetic oligonucleotide
  Target: SOD1; (-) strand; PAM type: YTN; PAM sequence: TTC
aaaaacatattgtgaaatga

SEQ ID NO: 12236 - DNA, 20 bp, Artificial Sequence
  Description of Artificial Sequence: Synthetic oligonucleotide
  Target: SOD1; (-) strand; PAM type: YTN; PAM sequence: TTT
caaaaacatattgtgaaatg

SEQ ID NO: 12237 - DNA, 20 bp, Artificial Sequence
  Description of Artificial Sequence: Synthetic oligonucleotide
  Target: SOD1; (-) strand; PAM type: YTN; PAM sequence: TTC
aagggaaatatttcaaaaac

SEQ ID NO: 12238 - DNA, 20 bp, Artificial Sequence
  Description of Artificial Sequence: Synthetic oligonucleotide
  Target: SOD1; (-) strand; PAM type: YTN; PAM sequence: TTT
caagggaaatatttcaaaaa

SEQ ID NO: 12239 - DNA, 20 bp, Artificial Sequence
  Description of Artificial Sequence: Synthetic oligonucleotide
  Target: SOD1; (-) strand; PAM type: YTN; PAM sequence: CTT
tcaagggaaatatttcaaaa

SEQ ID NO: 12240 - DNA, 20 bp, Artificial Sequence
  Description of Artificial Sequence: Synthetic oligonucleotide
  Target: SOD1; (-) strand; PAM type: YTN; PAM sequence: TTA
cctttcaagggaaatatttc

SEQ ID NO: 12241 - DNA, 20 bp, Artificial Sequence
  Description of Artificial Sequence: Synthetic oligonucleotide
  Target: SOD1; (-) strand; PAM type: YTN; PAM sequence: CTT
acctttcaagggaaatattt

SEQ ID NO: 12242 - DNA, 20 bp, Artificial Sequence
  Description of Artificial Sequence: Synthetic oligonucleotide
  Target: SOD1; (-) strand; PAM type: YTN; PAM sequence: CTC
catacaacaggaatgataaa

SEQ ID NO: 12243 - DNA, 20 bp, Artificial Sequence
  Description of Artificial Sequence: Synthetic oligonucleotide
  Target: SOD1; (-) strand; PAM type: YTN; PAM sequence: TTA
tgatgcctccatacaacagg

SEQ ID NO: 12244 - DNA, 20 bp, Artificial Sequence
  Description of Artificial Sequence: Synthetic oligonucleotide
  Target: SOD1; (-) strand; PAM type: YTN; PAM sequence: TTT
atgatgcctccatacaacag

SEQ ID NO: 12245 - DNA, 20 bp, Artificial Sequence
  Description of Artificial Sequence: Synthetic oligonucleotide
  Target: SOD1; (-) strand; PAM type: YTN; PAM sequence: CTC
aaggagggtagaatggtgaa

SEQ ID NO: 12246 - DNA, 20 bp, Artificial Sequence
  Description of Artificial Sequence: Synthetic oligonucleotide
  Target: SOD1; (-) strand; PAM type: YTN; PAM sequence: CTA
aaggccacaacactcaagga

SEQ ID NO: 12247 - DNA, 20 bp, Artificial Sequence
  Description of Artificial Sequence: Synthetic oligonucleotide
  Target: SOD1; (-) strand; PAM type: YTN; PAM sequence: CTG
gcctaaaggccacaacactc

SEQ ID NO: 12248 - DNA, 20 bp, Artificial Sequence
  Description of Artificial Sequence: Synthetic oligonucleotide
  Target: SOD1; (-) strand; PAM type: YTN; PAM sequence: TTG
tctggcctaaaggccacaac

SEQ ID NO: 12249 - DNA, 20 bp, Artificial Sequence
  Description of Artificial Sequence: Synthetic oligonucleotide
  Target: SOD1; (-) strand; PAM type: YTN; PAM sequence: TTT
gtctggcctaaaggccacaa

SEQ ID NO: 12250 - DNA, 20 bp, Artificial Sequence
  Description of Artificial Sequence: Synthetic oligonucleotide
  Target: SOD1; (-) strand; PAM type: YTN; PAM sequence: TTT
tgtctggcctaaaggccaca

SEQ ID NO: 12251 - DNA, 20 bp, Artificial Sequence
  Description of Artificial Sequence: Synthetic oligonucleotide
  Target: SOD1; (-) strand; PAM type: YTN; PAM sequence: TTT
ttgtctggcctaaaggccac

SEQ ID NO: 12252 - DNA, 20 bp, Artificial Sequence
  Description of Artificial Sequence: Synthetic oligonucleotide
  Target: SOD1; (-) strand; PAM type: YTN; PAM sequence: CTG
cgtttttgtctggcctaaag

SEQ ID NO: 12253 - DNA, 20 bp, Artificial Sequence
  Description of Artificial Sequence: Synthetic oligonucleotide
  Target: SOD1; (-) strand; PAM type: YTN; PAM sequence: CTA
ggcatcacctgcgtttttgt

SEQ ID NO: 12254 - DNA, 20 bp, Artificial Sequence
  Description of Artificial Sequence: Synthetic oligonucleotide
  Target: SOD1; (-) strand; PAM type: YTN; PAM sequence: TTC
taggcatcacctgcgttttt

SEQ ID NO: 12255 - DNA, 20 bp, Artificial Sequence
  Description of Artificial Sequence: Synthetic oligonucleotide
  Target: SOD1; (-) strand; PAM type: YTN; PAM sequence: CTT
ctaggcatcacctgcgtttt

SEQ ID NO: 12256 - DNA, 20 bp, Artificial Sequence
  Description of Artificial Sequence: Synthetic oligonucleotide
  Target: SOD1; (-) strand; PAM type: YTN; PAM sequence: TTG
gcttctaggcatcacctgcg

SEQ ID NO: 12257 - DNA, 20 bp, Artificial Sequence
  Description of Artificial Sequence: Synthetic oligonucleotide
  Target: SOD1; (-) strand; PAM type: YTN; PAM sequence: CTA
gttggcttctaggcatcacc

SEQ ID NO: 12258 - DNA, 20 bp, Artificial Sequence
  Description of Artificial Sequence: Synthetic oligonucleotide
  Target: SOD1; (-) strand; PAM type: YTN; PAM sequence: CTA
cagataaccaaacggcaact

SEQ ID NO: 12259 - DNA, 20 bp, Artificial Sequence
  Description of Artificial Sequence: Synthetic oligonucleotide
  Target: SOD1; (-) strand; PAM type: YTN; PAM sequence: TTG
gcaaggccacaaccctacag

SEQ ID NO: 12260 - DNA, 20 bp, Artificial Sequence
  Description of Artificial Sequence: Synthetic oligonucleotide
  Target: SOD1; (-) strand; PAM type: YTN; PAM sequence: TTT
ggcaaggccacaaccctaca

SEQ ID NO: 12261 - DNA, 20 bp, Artificial Sequence
  Description of Artificial Sequence: Synthetic oligonucleotide
  Target: SOD1; (-) strand; PAM type: YTN; PAM sequence: CTG
tttggcaaggccacaaccct

SEQ ID NO: 12262 - DNA, 20 bp, Artificial Sequence
  Description of Artificial Sequence: Synthetic oligonucleotide
  Target: SOD1; (-) strand; PAM type: YTN; PAM sequence: TTC
ctgtttggcaaggccacaac

SEQ ID NO: 12263 - DNA, 20 bp, Artificial Sequence
  Description of Artificial Sequence: Synthetic oligonucleotide
  Target: SOD1; (-) strand; PAM type: YTN; PAM sequence: TTT
cctgtttggcaaggccacaa

SEQ ID NO: 12264 - DNA, 20 bp, Artificial Sequence
  Description of Artificial Sequence: Synthetic oligonucleotide
  Target: SOD1; (-) strand; PAM type: YTN; PAM sequence: TTT
tcctgtttggcaaggccaca

SEQ ID NO: 12265 - DNA, 20 bp, Artificial Sequence
  Description of Artificial Sequence: Synthetic oligonucleotide
  Target: SOD1; (-) strand; PAM type: YTN; PAM sequence: TTT
ttcctgtttggcaaggccac

SEQ ID NO: 12266 - DNA, 20 bp, Artificial Sequence
  Description of Artificial Sequence: Synthetic oligonucleotide
  Target: SOD1; (-) strand; PAM type: YTN; PAM sequence: TTA
tatttttcctgtttggcaag

SEQ ID NO: 12267 - DNA, 20 bp, Artificial Sequence
  Description of Artificial Sequence: Synthetic oligonucleotide
  Target: SOD1; (-) strand; PAM type: YTN; PAM sequence: TTT
atatttttcctgtttggcaa

SEQ ID NO: 12268 - DNA, 20 bp, Artificial Sequence
  Description of Artificial Sequence: Synthetic oligonucleotide
  Target: SOD1; (-) strand; PAM type: YTN; PAM sequence: TTT
tatatttttcctgtttggca

SEQ ID NO: 12269 - DNA, 20 bp, Artificial Sequence
  Description of Artificial Sequence: Synthetic oligonucleotide
  Target: SOD1; (-) strand; PAM type: YTN; PAM sequence: TTT
ttatatttttcctgtttggc

SEQ ID NO: 12270 - DNA, 20 bp, Artificial Sequence
  Description of Artificial Sequence: Synthetic oligonucleotide
  Target: SOD1; (-) strand; PAM type: YTN; PAM sequence: CTT
tttatatttttcctgtttgg

SEQ ID NO: 12271 - DNA, 20 bp, Artificial Sequence
  Description of Artificial Sequence: Synthetic oligonucleotide
  Target: SOD1; (-) strand; PAM type: YTN; PAM sequence: TTC
tttttatatttttcctgttt

SEQ ID NO: 12272 - DNA, 20 bp, Artificial Sequence
  Description of Artificial Sequence: Synthetic oligonucleotide
  Target: SOD1; (-) strand; PAM type: YTN; PAM sequence: TTC
ggtattctttttatattttt

SEQ ID NO: 12273 - DNA, 20 bp, Artificial Sequence
  Description of Artificial Sequence: Synthetic oligonucleotide
  Target: SOD1; (-) strand; PAM type: YTN; PAM sequence: TTG
gcagaattcggtattctttt

SEQ ID NO: 12274 - DNA, 20 bp, Artificial Sequence
  Description of Artificial Sequence: Synthetic oligonucleotide
  Target: SOD1; (-) strand; PAM type: YTN; PAM sequence: TTG
gttggcagaattcggtattc

SEQ ID NO: 12275 - DNA, 20 bp, Artificial Sequence
  Description of Artificial Sequence: Synthetic oligonucleotide
  Target: SOD1; (-) strand; PAM type: YTN; PAM sequence: TTT
ggttggcagaattcggtatt

SEQ ID NO: 12276 - DNA, 20 bp, Artificial Sequence
  Description of Artificial Sequence: Synthetic oligonucleotide
  Target: SOD1; (-) strand; PAM type: YTN; PAM sequence: TTA
tttggttggcagaattcggt

SEQ ID NO: 12277 - DNA, 20 bp, Artificial Sequence
  Description of Artificial Sequence: Synthetic oligonucleotide
  Target: SOD1; (-) strand; PAM type: YTN; PAM sequence: CTT
atttggttggcagaattcgg

SEQ ID NO: 12278 - DNA, 20 bp, Artificial Sequence
  Description of Artificial Sequence: Synthetic oligonucleotide
  Target: SOD1; (-) strand; PAM type: YTN; PAM sequence: TTC
ttatttggttggcagaattc

SEQ ID NO: 12279 - DNA, 20 bp, Artificial Sequence
  Description of Artificial Sequence: Synthetic oligonucleotide
  Target: SOD1; (-) strand; PAM type: YTN; PAM sequence: TTT
cttatttggttggcagaatt

SEQ ID NO: 12280 - DNA, 20 bp, Artificial Sequence
  Description of Artificial Sequence: Synthetic oligonucleotide
  Target: SOD1; (-) strand; PAM type: YTN; PAM sequence: TTA
gtatagagtttcttatttgg

SEQ ID NO: 12281 - DNA, 20 bp, Artificial Sequence
  Description of Artificial Sequence: Synthetic oligonucleotide
  Target: SOD1; (-) strand; PAM type: YTN; PAM sequence: CTT
agtatagagtttcttatttg

SEQ ID NO: 12282 - DNA, 20 bp, Artificial Sequence
  Description of Artificial Sequence: Synthetic oligonucleotide
  Target: SOD1; (-) strand; PAM type: YTN; PAM sequence: TTA
gtccttagtatagagtttct

SEQ ID NO: 12283 - DNA, 20 bp, Artificial Sequence
  Description of Artificial Sequence: Synthetic oligonucleotide
  Target: SOD1; (-) strand; PAM type: YTN; PAM sequence: CTT
agtccttagtatagagtttc

SEQ ID NO: 12284 - DNA, 20 bp, Artificial Sequence
  Description of Artificial Sequence: Synthetic oligonucleotide
  Target: SOD1; (-) strand; PAM type: YTN; PAM sequence: TTC
ttagtccttagtatagagtt

SEQ ID NO: 12285 - DNA, 20 bp, Artificial Sequence
  Description of Artificial Sequence: Synthetic oligonucleotide
  Target: SOD1; (-) strand; PAM type: YTN; PAM sequence: TTT
cttagtccttagtatagagt

SEQ ID NO: 12286 - DNA, 20 bp, Artificial Sequence
  Description of Artificial Sequence: Synthetic oligonucleotide
  Target: SOD1; (-) strand; PAM type: YTN; PAM sequence: TTT
tcttagtccttagtatagag

SEQ ID NO: 12287 - DNA, 20 bp, Artificial Sequence
  Description of Artificial Sequence: Synthetic oligonucleotide
  Target: SOD1; (-) strand; PAM type: YTN; PAM sequence: CTG
caattttcttagtccttagt

SEQ ID NO: 12288 - DNA, 20 bp, Artificial Sequence
  Description of Artificial Sequence: Synthetic oligonucleotide
  Target: SOD1; (-) strand; PAM type: YTN; PAM sequence: TTC
ccctgcaattttcttagtcc

SEQ ID NO: 12289 - DNA, 20 bp, Artificial Sequence
  Description of Artificial Sequence: Synthetic oligonucleotide
  Target: SOD1; (-) strand; PAM type: YTN; PAM sequence: CTT
cccctgcaattttcttagtc

SEQ ID NO: 12290 - DNA, 20 bp, Artificial Sequence
  Description of Artificial Sequence: Synthetic oligonucleotide
  Target: SOD1; (-) strand; PAM type: YTN; PAM sequence: TTC
ttcccctgcaattttcttag

SEQ ID NO: 12291 - DNA, 20 bp, Artificial Sequence
  Description of Artificial Sequence: Synthetic oligonucleotide
  Target: SOD1; (-) strand; PAM type: YTN; PAM sequence: TTT
cttcccctgcaattttctta

SEQ ID NO: 12292 - DNA, 20 bp, Artificial Sequence
  Description of Artificial Sequence: Synthetic oligonucleotide
  Target: SOD1; (-) strand; PAM type: YTN; PAM sequence: TTT
tcttcccctgcaattttctt

SEQ ID NO: 12293 - DNA, 20 bp, Artificial Sequence
  Description of Artificial Sequence: Synthetic oligonucleotide
  Target: SOD1; (-) strand; PAM type: YTN; PAM sequence: CTT
ttcttcccctgcaattttct

SEQ ID NO: 12294 - DNA, 20 bp, Artificial Sequence
  Description of Artificial Sequence: Synthetic oligonucleotide
  Target: SOD1; (-) strand; PAM type: YTN; PAM sequence: TTA
ccttttcttcccctgcaatt

SEQ ID NO: 12295 - DNA, 20 bp, Artificial Sequence
  Description of Artificial Sequence: Synthetic oligonucleotide
  Target: SOD1; (-) strand; PAM type: YTN; PAM sequence: CTT
accttttcttcccctgcaat

SEQ ID NO: 12296 - DNA, 20 bp, Artificial Sequence
  Description of Artificial Sequence: Synthetic oligonucleotide
  Target: SOD1; (-) strand; PAM type: YTN; PAM sequence: CTC
aatcccgggacttacctttt

SEQ ID NO: 12297 - DNA, 20 bp, Artificial Sequence
  Description of Artificial Sequence: Synthetic oligonucleotide
  Target: SOD1; (-) strand; PAM type: YTN; PAM sequence: CTA
cacctcaatcccgggactta

SEQ ID NO: 12298 - DNA, 20 bp, Artificial Sequence
  Description of Artificial Sequence: Synthetic oligonucleotide
  Target: SOD1; (-) strand; PAM type: YTN; PAM sequence: CTG
agggtatagaaagtcgctac

SEQ ID NO: 12299 - DNA, 20 bp, Artificial Sequence
  Description of Artificial Sequence: Synthetic oligonucleotide
  Target: SOD1; (-) strand; PAM type: YTN; PAM sequence: TTC
tgagggtatagaaagtcgct

SEQ ID NO: 12300 - DNA, 20 bp, Artificial Sequence
  Description of Artificial Sequence: Synthetic oligonucleotide
  Target: SOD1; (-) strand; PAM type: YTN; PAM sequence: TTT
ctgagggtatagaaagtcgc

SEQ ID NO: 12301 - DNA, 20 bp, Artificial Sequence
  Description of Artificial Sequence: Synthetic oligonucleotide
  Target: SOD1; (-) strand; PAM type: YTN; PAM sequence: TTT
tctgagggtatagaaagtcg

SEQ ID NO: 12302 - DNA, 20 bp, Artificial Sequence
  Description of Artificial Sequence: Synthetic oligonucleotide
  Target: SOD1; (-) strand; PAM type: YTN; PAM sequence: TTA
gttttctgagggtatagaaa

SEQ ID NO: 12303 - DNA, 20 bp, Artificial Sequence
  Description of Artificial Sequence: Synthetic oligonucleotide
  Target: SOD1; (-) strand; PAM type: YTN; PAM sequence: TTT
agttttctgagggtatagaa

SEQ ID NO: 12304 - DNA, 20 bp, Artificial Sequence
  Description of Artificial Sequence: Synthetic oligonucleotide
  Target: SOD1; (-) strand; PAM type: YTN; PAM sequence: TTT
tagttttctgagggtataga

SEQ ID NO: 12305 - DNA, 20 bp, Artificial Sequence
  Description of Artificial Sequence: Synthetic oligonucleotide
  Target: SOD1; (-) strand; PAM type: YTN; PAM sequence: TTT
ttagttttctgagggtatag

SEQ ID NO: 12306 - DNA, 20 bp, Artificial Sequence
  Description of Artificial Sequence: Synthetic oligonucleotide
  Target: SOD1; (-) strand; PAM type: YTN; PAM sequence: TTT
tttagttttctgagggtata

SEQ ID NO: 12307 - DNA, 20 bp, Artificial Sequence
  Description of Artificial Sequence: Synthetic oligonucleotide
  Target: SOD1; (-) strand; PAM type: YTN; PAM sequence: TTG
ttttttagttttctgagggt

SEQ ID NO: 12308 - DNA, 20 bp, Artificial Sequence
  Description of Artificial Sequence: Synthetic oligonucleotide
  Target: SOD1; (-) strand; PAM type: YTN; PAM sequence: CTT
gttttttagttttctgaggg

SEQ ID NO: 12309 - DNA, 20 bp, Artificial Sequence
  Description of Artificial Sequence: Synthetic oligonucleotide
  Target: SOD1; (-) strand; PAM type: YTN; PAM sequence: TTG
tcttgttttttagttttctg

SEQ ID NO: 12310 - DNA, 20 bp, Artificial Sequence
  Description of Artificial Sequence: Synthetic oligonucleotide
  Target: SOD1; (-) strand; PAM type: YTN; PAM sequence: TTT
gtcttgttttttagttttct

SEQ ID NO: 12311 - DNA, 20 bp, Artificial Sequence
  Description of Artificial Sequence: Synthetic oligonucleotide
  Target: SOD1; (-) strand; PAM type: YTN; PAM sequence: TTT
tgtcttgttttttagttttc

SEQ ID NO: 12312 - DNA, 20 bp, Artificial Sequence
  Description of Artificial Sequence: Synthetic oligonucleotide
  Target: SOD1; (-) strand; PAM type: YTN; PAM sequence: TTT
ttgtcttgttttttagtttt

SEQ ID NO: 12313 - DNA, 20 bp, Artificial Sequence
  Description of Artificial Sequence: Synthetic oligonucleotide
  Target: SOD1; (-) strand; PAM type: YTN; PAM sequence: TTT
tttgtcttgttttttagttt

SEQ ID NO: 12314 - DNA, 20 bp, Artificial Sequence
  Description of Artificial Sequence: Synthetic oligonucleotide
  Target: SOD1; (-) strand; PAM type: YTN; PAM sequence: TTT
ttttgtcttgttttttagtt

SEQ ID NO: 12315 - DNA, 20 bp, Artificial Sequence
  Description of Artificial Sequence: Synthetic oligonucleotide
  Target: SOD1; (-) strand; PAM type: YTN; PAM sequence: TTC
atttttttgtcttgtttttt

SEQ ID NO: 12316 - DNA, 20 bp, Artificial Sequence
  Description of Artificial Sequence: Synthetic oligonucleotide
  Target: SOD1; (-) strand; PAM type: YTN; PAM sequence: TTT
catttttttgtcttgttttt

SEQ ID NO: 12317 - DNA, 20 bp, Artificial Sequence
  Description of Artificial Sequence: Synthetic oligonucleotide
  Target: SOD1; (-) strand; PAM type: YTN; PAM sequence: TTT
tcatttttttgtcttgtttt

SEQ ID NO: 12318 - DNA, 20 bp, Artificial Sequence
  Description of Artificial Sequence: Synthetic oligonucleotide
  Target: SOD1; (-) strand; PAM type: YTN; PAM sequence: TTG
tagttttcatttttttgtct

SEQ ID NO: 12319 - DNA, 20 bp, Artificial Sequence
  Description of Artificial Sequence: Synthetic oligonucleotide
  Target: SOD1; (-) strand; PAM type: YTN; PAM sequence: TTT
gtagttttcatttttttgtc

SEQ ID NO: 12320 - DNA, 20 bp, Artificial Sequence
  Description of Artificial Sequence: Synthetic oligonucleotide
  Target: SOD1; (-) strand; PAM type: YTN; PAM sequence: TTT
tgtagttttcatttttttgt

SEQ ID NO: 12321 - DNA, 20 bp, Artificial Sequence
  Description of Artificial Sequence: Synthetic oligonucleotide
  Target: SOD1; (-) strand; PAM type: YTN; PAM sequence: CTT
ttgtagttttcatttttttg

SEQ ID NO: 12322 - DNA, 20 bp, Artificial Sequence
  Description of Artificial Sequence: Synthetic oligonucleotide
  Target: SOD1; (-) strand; PAM type: YTN; PAM sequence: TTG
ggacgccccaagatggatgc

SEQ ID NO: 12323 - DNA, 20 bp, Artificial Sequence
  Description of Artificial Sequence: Synthetic oligonucleotide
  Target: SOD1; (-) strand; PAM type: YTN; PAM sequence: CTC
agcaattgggacgccccaag

SEQ ID NO: 12324 - DNA, 20 bp, Artificial Sequence
  Description of Artificial Sequence: Synthetic oligonucleotide
  Target: SOD1; (-) strand; PAM type: YTN; PAM sequence: TTA
ctcagcaattgggacgcccc

SEQ ID NO: 12325 - DNA, 20 bp, Artificial Sequence
  Description of Artificial Sequence: Synthetic oligonucleotide
  Target: SOD1; (-) strand; PAM type: YTN; PAM sequence: TTG
ttactcagcaattgggacgc

SEQ ID NO: 12326 - DNA, 20 bp, Artificial Sequence
  Description of Artificial Sequence: Synthetic oligonucleotide
  Target: SOD1; (-) strand; PAM type: YTN; PAM sequence: TTT
gttactcagcaattgggacg

SEQ ID NO: 12327 - DNA, 20 bp, Artificial Sequence
  Description of Artificial Sequence: Synthetic oligonucleotide
  Target: SOD1; (-) strand; PAM type: YTN; PAM sequence: CTC
atttgttactcagcaattgg

SEQ ID NO: 12328 - DNA, 20 bp, Artificial Sequence
  Description of Artificial Sequence: Synthetic oligonucleotide
  Target: SOD1; (-) strand; PAM type: YTN; PAM sequence: TTG
gccacagcgtctcatttgtt

SEQ ID NO: 12329 - DNA, 20 bp, Artificial Sequence
  Description of Artificial Sequence: Synthetic oligonucleotide
  Target: SOD1; (-) strand; PAM type: YTN; PAM sequence: TTT
ggccacagcgtctcatttgt

SEQ ID NO: 12330 - DNA, 20 bp, Artificial Sequence
  Description of Artificial Sequence: Synthetic oligonucleotide
  Target: SOD1; (-) strand; PAM type: YTN; PAM sequence: CTG
agtttggccacagcgtctca

SEQ ID NO: 12331 - DNA, 20 bp, Artificial Sequence
  Description of Artificial Sequence: Synthetic oligonucleotide
  Target: SOD1; (-) strand; PAM type: YTN; PAM sequence: TTA
tgactgagtttggccacagc

SEQ ID NO: 12332 - DNA, 20 bp, Artificial Sequence
  Description of Artificial Sequence: Synthetic oligonucleotide
  Target: SOD1; (-) strand; PAM type: YTN; PAM sequence: TTA
gttatgactgagtttggcca

SEQ ID NO: 12333 - DNA, 20 bp, Artificial Sequence
  Description of Artificial Sequence: Synthetic oligonucleotide
  Target: SOD1; (-) strand; PAM type: YTN; PAM sequence: CTA
gaaatgtcattagttatgac

SEQ ID NO: 12334 - DNA, 20 bp, Artificial Sequence
  Description of Artificial Sequence: Synthetic oligonucleotide
  Target: SOD1; (-) strand; PAM type: YTN; PAM sequence: TTG
tctagaaatgtcattagtta

SEQ ID NO: 12335 - DNA, 20 bp, Artificial Sequence
  Description of Artificial Sequence: Synthetic oligonucleotide
  Target: SOD1; (-) strand; PAM type: YTN; PAM sequence: TTT
gtctagaaatgtcattagtt

SEQ ID NO: 12336 - DNA, 20 bp, Artificial Sequence
  Description of Artificial Sequence: Synthetic oligonucleotide
  Target: SOD1; (-) strand; PAM type: YTN; PAM sequence: CTT
tgtctagaaatgtcattagt

SEQ ID NO: 12337 - DNA, 20 bp, Artificial Sequence
  Description of Artificial Sequence: Synthetic oligonucleotide
  Target: SOD1; (-) strand; PAM type: YTN; PAM sequence: CTG
aagtcactttgtctagaaat

SEQ ID NO: 12338 - DNA, 20 bp, Artificial Sequence
  Description of Artificial Sequence: Synthetic oligonucleotide
  Target: SOD1; (-) strand; PAM type: YTN; PAM sequence: TTG
aaaatctgaagtcactttgt

SEQ ID NO: 12339 - DNA, 20 bp, Artificial Sequence
  Description of Artificial Sequence: Synthetic oligonucleotide
  Target: SOD1; (-) strand; PAM type: YTN; PAM sequence: TTT
gaaaatctgaagtcactttg

SEQ ID NO: 12340 - DNA, 20 bp, Artificial Sequence
  Description of Artificial Sequence: Synthetic oligonucleotide
  Target: SOD1; (-) strand; PAM type: YTN; PAM sequence: CTT
tgaaaatctgaagtcacttt

SEQ ID NO: 12341 - DNA, 20 bp, Artificial Sequence
  Description of Artificial Sequence: Synthetic oligonucleotide
  Target: SOD1; (-) strand; PAM type: YTN; PAM sequence: TTG
gcaaaatgatgtaaacaggg

SEQ ID NO: 12342 - DNA, 20 bp, Artificial Sequence
  Description of Artificial Sequence: Synthetic oligonucleotide
  Target: SOD1; (-) strand; PAM type: YTN; PAM sequence: TTG
cagtacgcgaaattggcaaa

SEQ ID NO: 12343 - DNA, 20 bp, Artificial Sequence
  Description of Artificial Sequence: Synthetic oligonucleotide
  Target: SOD1; (-) strand; PAM type: YTN; PAM sequence: TTC
acgggggcgtggcccgccgg

SEQ ID NO: 12344 - DNA, 20 bp, Artificial Sequence
  Description of Artificial Sequence: Synthetic oligonucleotide
  Target: SOD1; (-) strand; PAM type: YTN; PAM sequence: TTT
cacgggggcgtggcccgccg

SEQ ID NO: 12345 - DNA, 20 bp, Artificial Sequence
  Description of Artificial Sequence: Synthetic oligonucleotide
  Target: SOD1; (-) strand; PAM type: YTN; PAM sequence: TTT
tcacgggggcgtggcccgcc

SEQ ID NO: 12346 - DNA, 20 bp, Artificial Sequence
  Description of Artificial Sequence: Synthetic oligonucleotide
  Target: SOD1; (-) strand; PAM type: YTN; PAM sequence: CTT
ttcacgggggcgtggcccgc

SEQ ID NO: 12347 - DNA, 20 bp, Artificial Sequence
  Description of Artificial Sequence: Synthetic oligonucleotide
  Target: SOD1; (-) strand; PAM type: YTN; PAM sequence: TTC
ttttcacgggggcgtggccc

SEQ ID NO: 12348 - DNA, 20 bp, Artificial Sequence
  Description of Artificial Sequence: Synthetic oligonucleotide
  Target: SOD1; (-) strand; PAM type: YTN; PAM sequence: CTT
cttttcacgggggcgtggcc

SEQ ID NO: 12349 - DNA, 20 bp, Artificial Sequence
  Description of Artificial Sequence: Synthetic oligonucleotide
  Target: SOD1; (-) strand; PAM type: YTN; PAM sequence: CTC
cccccgccccgcagccggga

SEQ ID NO: 12350 - DNA, 20 bp, Artificial Sequence
  Description of Artificial Sequence: Synthetic oligonucleotide
  Target: SOD1; (-) strand; PAM type: YTN; PAM sequence: CTG
ggggcggggccaaggggccg

SEQ ID NO: 12351 - DNA, 20 bp, Artificial Sequence
  Description of Artificial Sequence: Synthetic oligonucleotide
  Target: SOD1; (-) strand; PAM type: YTN; PAM sequence: CTC
gggtcgcgagtggccgggaa

SEQ ID NO: 12352 - DNA, 20 bp, Artificial Sequence
  Description of Artificial Sequence: Synthetic oligonucleotide
  Target: SOD1; (-) strand; PAM type: YTN; PAM sequence: CTG
cggcagcctcgggtcgcgag

SEQ ID NO: 12353 - DNA, 20 bp, Artificial Sequence
  Description of Artificial Sequence: Synthetic oligonucleotide
  Target: SOD1; (-) strand; PAM type: YTN; PAM sequence: CTC
agcccgccccctgcggcagc

SEQ ID NO: 12354 - DNA, 20 bp, Artificial Sequence
  Description of Artificial Sequence: Synthetic oligonucleotide
  Target: SOD1; (-) strand; PAM type: YTN; PAM sequence: CTC
gcacgcgctcagcccgcccc

SEQ ID NO: 12355 - DNA, 20 bp, Artificial Sequence
  Description of Artificial Sequence: Synthetic oligonucleotide
  Target: SOD1; (-) strand; PAM type: YTN; PAM sequence: CTG
gccccaaaccaatcgcctcg

SEQ ID NO: 12356 - DNA, 20 bp, Artificial Sequence
  Description of Artificial Sequence: Synthetic oligonucleotide
  Target: SOD1; (-) strand; PAM type: YTN; PAM sequence: CTC
tggccccaaaccaatcgcct

SEQ ID NO: 12357 - DNA, 20 bp, Artificial Sequence
  Description of Artificial Sequence: Synthetic oligonucleotide
  Target: SOD1; (-) strand; PAM type: YTN; PAM sequence: CTC
gcccactctggccccaaacc

SEQ ID NO: 12358 - DNA, 20 bp, Artificial Sequence
  Description of Artificial Sequence: Synthetic oligonucleotide
  Target: SOD1; (-) strand; PAM type: YTN; PAM sequence: CTC
cgcgcctcgcccactctggc

SEQ ID NO: 12359 - DNA, 20 bp, Artificial Sequence
  Description of Artificial Sequence: Synthetic oligonucleotide
  Target: SOD1; (-) strand; PAM type: YTN; PAM sequence: TTA
taggccagacctccgcgcct

SEQ ID NO: 12360 - DNA, 20 bp, Artificial Sequence
  Description of Artificial Sequence: Synthetic oligonucleotide
  Target: SOD1; (-) strand; PAM type: YTN; PAM sequence: TTT
ataggccagacctccgcgcc

SEQ ID NO: 12361 - DNA, 20 bp, Artificial Sequence
  Description of Artificial Sequence: Synthetic oligonucleotide
  Target: SOD1; (-) strand; PAM type: YTN; PAM sequence: CTT
tataggccagacctccgcgc

SEQ ID NO: 12362 - DNA, 20 bp, Artificial Sequence
  Description of Artificial Sequence: Synthetic oligonucleotide
  Target: SOD1; (-) strand; PAM type: YTN; PAM sequence: CTA
ctttataggccagacctccg

SEQ ID NO: 12363 - DNA, 20 bp, Artificial Sequence
  Description of Artificial Sequence: Synthetic oligonucleotide
  Target: SOD1; (-) strand; PAM type: YTN; PAM sequence: CTC
cgcgactactttataggcca

SEQ ID NO: 12364 - DNA, 20 bp, Artificial Sequence
  Description of Artificial Sequence: Synthetic oligonucleotide
  Target: SOD1; (-) strand; PAM type: YTN; PAM sequence: CTA
cgacgcaaaccagcaccccg

SEQ ID NO: 12365 - DNA, 20 bp, Artificial Sequence
  Description of Artificial Sequence: Synthetic oligonucleotide
  Target: SOD1; (-) strand; PAM type: YTN; PAM sequence: CTG
caggagactacgacgcaaac

SEQ ID NO: 12366 - DNA, 20 bp, Artificial Sequence
  Description of Artificial Sequence: Synthetic oligonucleotide
  Target: SOD1; (-) strand; PAM type: YTN; PAM sequence: CTG
caacggaaaccccagacgct

SEQ ID NO: 12367 - DNA, 20 bp, Artificial Sequence
  Description of Artificial Sequence: Synthetic oligonucleotide
  Target: SOD1; (-) strand; PAM type: YTN; PAM sequence: TTC
cgaggactgcaacggaaacc

SEQ ID NO: 12368 - DNA, 20 bp, Artificial Sequence
  Description of Artificial Sequence: Synthetic oligonucleotide
  Target: SOD1; (-) strand; PAM type: YTN; PAM sequence: CTG
gttccgaggactgcaacgga

SEQ ID NO: 12369 - DNA, 20 bp, Artificial Sequence
  Description of Artificial Sequence: Synthetic oligonucleotide
  Target: SOD1; (-) strand; PAM type: YTN; PAM sequence: CTA
ggccacgccgaggtcctggt

SEQ ID NO: 12370 - DNA, 20 bp, Artificial Sequence
  Description of Artificial Sequence: Synthetic oligonucleotide
  Target: SOD1; (-) strand; PAM type: YTN; PAM sequence: CTC
gctaggccacgccgaggtcc

SEQ ID NO: 12371 - DNA, 20 bp, Artificial Sequence
  Description of Artificial Sequence: Synthetic oligonucleotide
  Target: SOD1; (-) strand; PAM type: YTN; PAM sequence: TTC
gtcgccataactcgctaggc

SEQ ID NO: 12372 - DNA, 20 bp, Artificial Sequence
  Description of Artificial Sequence: Synthetic oligonucleotide
  Target: SOD1; (-) strand; PAM type: YTN; PAM sequence: CTT
cgtcgccataactcgctagg

SEQ ID NO: 12373 - DNA, 20 bp, Artificial Sequence
  Description of Artificial Sequence: Synthetic oligonucleotide
  Target: SOD1; (-) strand; PAM type: YTN; PAM sequence: TTC
agcacgcacacggccttcgt

SEQ ID NO: 12374 - DNA, 20 bp, Artificial Sequence
  Description of Artificial Sequence: Synthetic oligonucleotide
  Target: SOD1; (-) strand; PAM type: YTN; PAM sequence: CTT
cagcacgcacacggccttcg

SEQ ID NO: 12375 - DNA, 20 bp, Artificial Sequence
  Description of Artificial Sequence: Synthetic oligonucleotide
  Target: SOD1; (-) strand; PAM type: YTN; PAM sequence: CTG
ggccgtcgcccttcagcacg

SEQ ID NO: 12376 - DNA, 20 bp, Artificial Sequence
  Description of Artificial Sequence: Synthetic oligonucleotide
  Target: SOD1; (-) strand; PAM type: YTN; PAM sequence: CTG
cactgggccgtcgcccttca

SEQ ID NO: 12377 - DNA, 20 bp, Artificial Sequence
  Description of Artificial Sequence: Synthetic oligonucleotide
  Target: SOD1; (-) strand; PAM type: YTN; PAM sequence: TTG
atgatgccctgcactgggcc

SEQ ID NO: 12378 - DNA, 20 bp, Artificial Sequence
  Description of Artificial Sequence: Synthetic oligonucleotide
  Target: SOD1; (-) strand; PAM type: YTN; PAM sequence: CTC
gaaattgatgatgccctgca

SEQ ID NO: 12379 - DNA, 20 bp, Artificial Sequence
  Description of Artificial Sequence: Synthetic oligonucleotide
  Target: SOD1; (-) strand; PAM type: YTN; PAM sequence: CTG
ctcgaaattgatgatgccct

SEQ ID NO: 12380 - DNA, 20 bp, Artificial Sequence
  Description of Artificial Sequence: Synthetic oligonucleotide
  Target: SOD1; (-) strand; PAM type: YTN; PAM sequence: TTC
tgctcgaaattgatgatgcc

SEQ ID NO: 12381 - DNA, 20 bp, Artificial Sequence
  Description of Artificial Sequence: Synthetic oligonucleotide
  Target: SOD1; (-) strand; PAM type: YTN; PAM sequence: CTT
ctgctcgaaattgatgatgc

SEQ ID NO: 12382 - DNA, 20 bp, Artificial Sequence
  Description of Artificial Sequence: Synthetic oligonucleotide
  Target: SOD1; (-) strand; PAM type: YTN; PAM sequence: TTG
ccttctgctcgaaattgatg

SEQ ID NO: 12383 - DNA, 20 bp, Artificial Sequence
  Description of Artificial Sequence: Synthetic oligonucleotide
  Target: SOD1; (-) strand; PAM type: YTN; PAM sequence: CTT
gccttctgctcgaaattgat

SEQ ID NO: 12384 - DNA, 20 bp, Artificial Sequence
  Description of Artificial Sequence: Synthetic oligonucleotide
  Target: SOD1; (-) strand; PAM type: YTN; PAM sequence: CTC
cgtcccagcccttgccttct

SEQ ID NO: 12385 - DNA, 20 bp, Artificial Sequence
  Description of Artificial Sequence: Synthetic oligonucleotide
  Target: SOD1; (-) strand; PAM type: YTN; PAM sequence: CTC
gcaaacaagcctccgtccca

SEQ ID NO: 12386 - DNA, 20 bp, Artificial Sequence
  Description of Artificial Sequence: Synthetic oligonucleotide
  Target: SOD1; (-) strand; PAM type: YTN; PAM sequence: CTA
gcaaaggtgcgcggggggac

SEQ ID NO: 12387 - DNA, 20 bp, Artificial Sequence
  Description of Artificial Sequence: Synthetic oligonucleotide
  Target: SOD1; (-) strand; PAM type: YTN; PAM sequence: CTC
ctagcaaaggtgcgcggggg

SEQ ID NO: 12388 - DNA, 20 bp, Artificial Sequence
  Description of Artificial Sequence: Synthetic oligonucleotide
  Target: SOD1; (-) strand; PAM type: YTN; PAM sequence: CTG
gcgggcgacccgctcctagc

SEQ ID NO: 12389 - DNA, 20 bp, Artificial Sequence
  Description of Artificial Sequence: Synthetic oligonucleotide
  Target: SOD1; (-) strand; PAM type: YTN; PAM sequence: CTG
gaccagggcggccccgaggc

SEQ ID NO: 12390 - DNA, 20 bp, Artificial Sequence
  Description of Artificial Sequence: Synthetic oligonucleotide
  Target: SOD1; (-) strand; PAM type: YTN; PAM sequence: CTG
ggggcgaaggcaccgaccgg

SEQ ID NO: 12391 - DNA, 20 bp, Artificial Sequence
  Description of Artificial Sequence: Synthetic oligonucleotide
  Target: SOD1; (-) strand; PAM type: YTN; PAM sequence: TTG
ggcaccgcaccgctgggggc

SEQ ID NO: 12392 - DNA, 20 bp, Artificial Sequence
  Description of Artificial Sequence: Synthetic oligonucleotide
  Target: SOD1; (-) strand; PAM type: YTN; PAM sequence: CTT
gggcaccgcaccgctggggg

SEQ ID NO: 12393 - DNA, 20 bp, Artificial Sequence
  Description of Artificial Sequence: Synthetic oligonucleotide
  Target: SOD1; (-) strand; PAM type: YTN; PAM sequence: CTC
agcacttgggcaccgcaccg

SEQ ID NO: 12394 - DNA, 20 bp, Artificial Sequence
  Description of Artificial Sequence: Synthetic oligonucleotide
  Target: SOD1; (-) strand; PAM type: YTN; PAM sequence: CTC
ggtcccacgccccgcgcccg

SEQ ID NO: 12395 - DNA, 20 bp, Artificial Sequence
  Description of Artificial Sequence: Synthetic oligonucleotide
  Target: SOD1; (-) strand; PAM type: YTN; PAM sequence: CTC
ccgccacgcgcaggcccagc

SEQ ID NO: 12396 - DNA, 20 bp, Artificial Sequence
  Description of Artificial Sequence: Synthetic oligonucleotide
  Target: SOD1; (-) strand; PAM type: YTN; PAM sequence: CTC
cccgcgctcccgccacgcgc

SEQ ID NO: 12397 - DNA, 20 bp, Artificial Sequence
  Description of Artificial Sequence: Synthetic oligonucleotide
  Target: SOD1; (-) strand; PAM type: YTN; PAM sequence: CTC
cccggcccgcggcaatccct

SEQ ID NO: 12398 - DNA, 20 bp, Artificial Sequence
  Description of Artificial Sequence: Synthetic oligonucleotide
  Target: SOD1; (-) strand; PAM type: YTN; PAM sequence: CTC
caggcaccacgacagacccg

SEQ ID NO: 12399 - DNA, 20 bp, Artificial Sequence
  Description of Artificial Sequence: Synthetic oligonucleotide
  Target: SOD1; (-) strand; PAM type: YTN; PAM sequence: CTC
aggaacgagaacacggccaa

SEQ ID NO: 12400 - DNA, 20 bp, Artificial Sequence
  Description of Artificial Sequence: Synthetic oligonucleotide
  Target: SOD1; (-) strand; PAM type: YTN; PAM sequence: CTC
ggtgtccgcgggaccctcag

SEQ ID NO: 12401 - DNA, 20 bp, Artificial Sequence
  Description of Artificial Sequence: Synthetic oligonucleotide
  Target: SOD1; (-) strand; PAM type: YTN; PAM sequence: CTG
cgccactcggtgtccgcggg

SEQ ID NO: 12402 - DNA, 20 bp, Artificial Sequence
  Description of Artificial Sequence: Synthetic oligonucleotide
  Target: SOD1; (-) strand; PAM type: YTN; PAM sequence: CTG
gcactgcgccactcggtgtc

SEQ ID NO: 12403 - DNA, 20 bp, Artificial Sequence
  Description of Artificial Sequence: Synthetic oligonucleotide
  Target: SOD1; (-) strand; PAM type: YTN; PAM sequence: CTG
ggcctggcactgcgccactc

SEQ ID NO: 12404 - DNA, 20 bp, Artificial Sequence
  Description of Artificial Sequence: Synthetic oligonucleotide
  Target: SOD1; (-) strand; PAM type: YTN; PAM sequence: CTG
aagccggaaagcggagaggg

SEQ ID NO: 12405 - DNA, 20 bp, Artificial Sequence
  Description of Artificial Sequence: Synthetic oligonucleotide
  Target: SOD1; (-) strand; PAM type: YTN; PAM sequence: CTA
gagcgctgaagccggaaagc

SEQ ID NO: 12406 - DNA, 20 bp, Artificial Sequence
  Description of Artificial Sequence: Synthetic oligonucleotide
  Target: SOD1; (-) strand; PAM type: YTN; PAM sequence: CTG
acctagagcgctgaagccgg

SEQ ID NO: 12407 - DNA, 20 bp, Artificial Sequence
  Description of Artificial Sequence: Synthetic oligonucleotide
  Target: SOD1; (-) strand; PAM type: YTN; PAM sequence: CTC
cctgacctagagcgctgaag

SEQ ID NO: 12408 - DNA, 20 bp, Artificial Sequence
  Description of Artificial Sequence: Synthetic oligonucleotide
  Target: SOD1; (-) strand; PAM type: YTN; PAM sequence: CTG
tacaaaagcgaagactccct

SEQ ID NO: 12409 - DNA, 20 bp, Artificial Sequence
  Description of Artificial Sequence: Synthetic oligonucleotide
  Target: SOD1; (-) strand; PAM type: YTN; PAM sequence: TTA
gagctgtacaaaagcgaaga

SEQ ID NO: 12410 - DNA, 20 bp, Artificial Sequence
  Description of Artificial Sequence: Synthetic oligonucleotide
  Target: SOD1; (-) strand; PAM type: YTN; PAM sequence: CTT
agagctgtacaaaagcgaag

SEQ ID NO: 12411 - DNA, 20 bp, Artificial Sequence
  Description of Artificial Sequence: Synthetic oligonucleotide
  Target: SOD1; (-) strand; PAM type: YTN; PAM sequence: CTA
gccttagagctgtacaaaag

SEQ ID NO: 12412 - DNA, 20 bp, Artificial Sequence
  Description of Artificial Sequence: Synthetic oligonucleotide
  Target: SOD1; (-) strand; PAM type: YTN; PAM sequence: TTC
ctagccttagagctgtacaa

SEQ ID NO: 12413 - DNA, 20 bp, Artificial Sequence
  Description of Artificial Sequence: Synthetic oligonucleotide
  Target: SOD1; (-) strand; PAM type: YTN; PAM sequence: TTA
aaaatataaaaaccattcct

SEQ ID NO: 12414 - DNA, 20 bp, Artificial Sequence
  Description of Artificial Sequence: Synthetic oligonucleotide
  Target: SOD1; (-) strand; PAM type: YTN; PAM sequence: TTT
aaaaatataaaaaccattcc

SEQ ID NO: 12415 - DNA, 20 bp, Artificial Sequence
  Description of Artificial Sequence: Synthetic oligonucleotide
  Target: SOD1; (-) strand; PAM type: YTN; PAM sequence: TTT
taaaaatataaaaaccattc

SEQ ID NO: 12416 - DNA, 20 bp, Artificial Sequence
  Description of Artificial Sequence: Synthetic oligonucleotide
  Target: SOD1; (-) strand; PAM type: YTN; PAM sequence: CTT
ttaaaaatataaaaaccatt

SEQ ID NO: 12417 - DNA, 20 bp, Artificial Sequence
  Description of Artificial Sequence: Synthetic oligonucleotide
  Target: SOD1; (-) strand; PAM type: YTN; PAM sequence: TTC
caaagccttttaaaaatata

SEQ ID NO: 12418 - DNA, 20 bp, Artificial Sequence
  Description of Artificial Sequence: Synthetic oligonucleotide
  Target: SOD1; (-) strand; PAM type: YTN; PAM sequence: TTT
ccaaagccttttaaaaatat

SEQ ID NO: 12419 - DNA, 20 bp, Artificial Sequence
  Description of Artificial Sequence: Synthetic oligonucleotide
  Target: SOD1; (-) strand; PAM type: YTN; PAM sequence: TTT
tccaaagccttttaaaaata

SEQ ID NO: 12420 - DNA, 20 bp, Artificial Sequence
  Description of Artificial Sequence: Synthetic oligonucleotide
  Target: SOD1; (-) strand; PAM type: YTN; PAM sequence: TTG
ttttccaaagccttttaaaa

SEQ ID NO: 12421 - DNA, 20 bp, Artificial Sequence
  Description of Artificial Sequence: Synthetic oligonucleotide
  Target: SOD1; (-) strand; PAM type: YTN; PAM sequence: TTT
gttttccaaagccttttaaa

SEQ ID NO: 12422 - DNA, 20 bp, Artificial Sequence
  Description of Artificial Sequence: Synthetic oligonucleotide
  Target: SOD1; (-) strand; PAM type: YTN; PAM sequence: TTT
tgttttccaaagccttttaa

SEQ ID NO: 12423 - DNA, 20 bp, Artificial Sequence
  Description of Artificial Sequence: Synthetic oligonucleotide
  Target: SOD1; (-) strand; PAM type: YTN; PAM sequence: TTT
ttgttttccaaagcctttta

SEQ ID NO: 12424 - DNA, 20 bp, Artificial Sequence
  Description of Artificial Sequence: Synthetic oligonucleotide
  Target: SOD1; (-) strand; PAM type: YTN; PAM sequence: TTG
cgtatttttgttttccaaag

SEQ ID NO: 12425 - DNA, 20 bp, Artificial Sequence
  Description of Artificial Sequence: Synthetic oligonucleotide
  Target: SOD1; (-) strand; PAM type: YTN; PAM sequence: CTG
ttgcgtatttttgttttcca

SEQ ID NO: 12426 - DNA, 20 bp, Artificial Sequence
  Description of Artificial Sequence: Synthetic oligonucleotide
  Target: SOD1; (-) strand; PAM type: YTN; PAM sequence: CTC
tgttgcgtatttttgttttc

SEQ ID NO: 12427 - DNA, 20 bp, Artificial Sequence
  Description of Artificial Sequence: Synthetic oligonucleotide
  Target: SOD1; (-) strand; PAM type: YTN; PAM sequence: CTG
caaagtgtcacacaaacggt

SEQ ID NO: 12428 - DNA, 20 bp, Artificial Sequence
  Description of Artificial Sequence: Synthetic oligonucleotide
  Target: SOD1; (-) strand; PAM type: YTN; PAM sequence: TTC
cctgcaaagtgtcacacaaa

SEQ ID NO: 12429 - DNA, 20 bp, Artificial Sequence
  Description of Artificial Sequence: Synthetic oligonucleotide
  Target: SOD1; (-) strand; PAM type: YTN; PAM sequence: CTT
ccctgcaaagtgtcacacaa

SEQ ID NO: 12430 - DNA, 20 bp, Artificial Sequence
  Description of Artificial Sequence: Synthetic oligonucleotide
  Target: SOD1; (-) strand; PAM type: YTN; PAM sequence: CTA
gaacagaggccagcaaactt

SEQ ID NO: 12431 - DNA, 20 bp, Artificial Sequence
  Description of Artificial Sequence: Synthetic oligonucleotide
  Target: SOD1; (-) strand; PAM type: YTN; PAM sequence: TTG
cagcccaatcatgacctaga

SEQ ID NO: 12432 - DNA, 20 bp, Artificial Sequence
  Description of Artificial Sequence: Synthetic oligonucleotide
  Target: SOD1; (-) strand; PAM type: YTN; PAM sequence: CTT
gcagcccaatcatgacctag

SEQ ID NO: 12433 - DNA, 20 bp, Artificial Sequence
  Description of Artificial Sequence: Synthetic oligonucleotide
  Target: SOD1; (-) strand; PAM type: YTN; PAM sequence: CTG
cccttgcagcccaatcatga

SEQ ID NO: 12434 - DNA, 20 bp, Artificial Sequence
  Description of Artificial Sequence: Synthetic oligonucleotide
  Target: SOD1; (-) strand; PAM type: YTN; PAM sequence: CTC
tgcccttgcagcccaatcat

SEQ ID NO: 12435 - DNA, 20 bp, Artificial Sequence
  Description of Artificial Sequence: Synthetic oligonucleotide
  Target: SOD1; (-) strand; PAM type: YTN; PAM sequence: TTC
tctgcccttgcagcccaatc

SEQ ID NO: 12436 - DNA, 20 bp, Artificial Sequence
  Description of Artificial Sequence: Synthetic oligonucleotide
  Target: SOD1; (-) strand; PAM type: YTN; PAM sequence: CTT
ctctgcccttgcagcccaat

SEQ ID NO: 12437 - DNA, 20 bp, Artificial Sequence
  Description of Artificial Sequence: Synthetic oligonucleotide
  Target: SOD1; (-) strand; PAM type: YTN; PAM sequence: CTA
ccttctctgcccttgcagcc

SEQ ID NO: 12438 - DNA, 20 bp, Artificial Sequence
  Description of Artificial Sequence: Synthetic oligonucleotide
  Target: SOD1; (-) strand; PAM type: YTN; PAM sequence: TTC
aaggctaccttctctgccct

SEQ ID NO: 12439 - DNA, 20 bp, Artificial Sequence
  Description of Artificial Sequence: Synthetic oligonucleotide
  Target: SOD1; (-) strand; PAM type: YTN; PAM sequence: CTG
ttcaaggctaccttctctgc

SEQ ID NO: 12440 - DNA, 20 bp, Artificial Sequence
  Description of Artificial Sequence: Synthetic oligonucleotide
  Target: SOD1; (-) strand; PAM type: YTN; PAM sequence: CTC
tgttcaaggctaccttctct

SEQ ID NO: 12441 - DNA, 20 bp, Artificial Sequence
  Description of Artificial Sequence: Synthetic oligonucleotide
  Target: SOD1; (-) strand; PAM type: YTN; PAM sequence: TTA
ggaggaggaaaaggacctct

SEQ ID NO: 12442 - DNA, 20 bp, Artificial Sequence
  Description of Artificial Sequence: Synthetic oligonucleotide
  Target: SOD1; (-) strand; PAM type: YTN; PAM sequence: CTT
aggaggaggaaaaggacctc

SEQ ID NO: 12443 - DNA, 20 bp, Artificial Sequence
  Description of Artificial Sequence: Synthetic oligonucleotide
  Target: SOD1; (-) strand; PAM type: YTN; PAM sequence: CTC
ccggagcttaggaggaggaa

SEQ ID NO: 12444 - DNA, 20 bp, Artificial Sequence
  Description of Artificial Sequence: Synthetic oligonucleotide
  Target: SOD1; (-) strand; PAM type: YTN; PAM sequence: CTG
gctcccggagcttaggagga

SEQ ID NO: 12445 - DNA, 20 bp, Artificial Sequence
  Description of Artificial Sequence: Synthetic oligonucleotide
  Target: SOD1; (-) strand; PAM type: YTN; PAM sequence: CTC
tggctcccggagcttaggag

SEQ ID NO: 12446 - DNA, 20 bp, Artificial Sequence
  Description of Artificial Sequence: Synthetic oligonucleotide
  Target: SOD1; (-) strand; PAM type: YTN; PAM sequence: TTA
aacctctggctcccggagct

SEQ ID NO: 12447 - DNA, 20 bp, Artificial Sequence
  Description of Artificial Sequence: Synthetic oligonucleotide
  Target: SOD1; (-) strand; PAM type: YTN; PAM sequence: CTC
aaaaatccccaaaagggtca

SEQ ID NO: 12448 - DNA, 20 bp, Artificial Sequence
  Description of Artificial Sequence: Synthetic oligonucleotide
  Target: SOD1; (-) strand; PAM type: YTN; PAM sequence: CTG
ccctcaaaaatccccaaaag

SEQ ID NO: 12449 - DNA, 20 bp, Artificial Sequence
  Description of Artificial Sequence: Synthetic oligonucleotide
  Target: SOD1; (-) strand; PAM type: YTN; PAM sequence: TTA
agatcactgccctcaaaaat

SEQ ID NO: 12450 - DNA, 20 bp, Artificial Sequence
  Description of Artificial Sequence: Synthetic oligonucleotide
  Target: SOD1; (-) strand; PAM type: YTN; PAM sequence: CTG
tgcacccaaagttaagatca

SEQ ID NO: 12451 - DNA, 20 bp, Artificial Sequence
  Description of Artificial Sequence: Synthetic oligonucleotide
  Target: SOD1; (-) strand; PAM type: YTN; PAM sequence: CTA
actgtgcacccaaagttaag

SEQ ID NO: 12452 - DNA, 20 bp, Artificial Sequence
  Description of Artificial Sequence: Synthetic oligonucleotide
  Target: SOD1; (-) strand; PAM type: YTN; PAM sequence: TTC
aaataagctaactgtgcacc

SEQ ID NO: 12453 - DNA, 20 bp, Artificial Sequence
  Description of Artificial Sequence: Synthetic oligonucleotide
  Target: SOD1; (-) strand; PAM type: YTN; PAM sequence: CTT
caaataagctaactgtgcac

SEQ ID NO: 12454 - DNA, 20 bp, Artificial Sequence
  Description of Artificial Sequence: Synthetic oligonucleotide
  Target: SOD1; (-) strand; PAM type: YTN; PAM sequence: TTA
gtaagatcttcaaataagct

SEQ ID NO: 12455 - DNA, 20 bp, Artificial Sequence
  Description of Artificial Sequence: Synthetic oligonucleotide
  Target: SOD1; (-) strand; PAM type: YTN; PAM sequence: TTT
agtaagatcttcaaataagc

SEQ ID NO: 12456 - DNA, 20 bp, Artificial Sequence
  Description of Artificial Sequence: Synthetic oligonucleotide
  Target: SOD1; (-) strand; PAM type: YTN; PAM sequence: TTT
tagtaagatcttcaaataag

SEQ ID NO: 12457 - DNA, 20 bp, Artificial Sequence
  Description of Artificial Sequence: Synthetic oligonucleotide
  Target: SOD1; (-) strand; PAM type: YTN; PAM sequence: TTT
ttagtaagatcttcaaataa

SEQ ID NO: 12458 - DNA, 20 bp, Artificial Sequence
  Description of Artificial Sequence: Synthetic oligonucleotide
  Target: SOD1; (-) strand; PAM type: YTN; PAM sequence: CTG
gtgtatttttagtaagatct

SEQ ID NO: 12459 - DNA, 20 bp, Artificial Sequence
  Description of Artificial Sequence: Synthetic oligonucleotide
  Target: SOD1; (-) strand; PAM type: YTN; PAM sequence: CTC
tggtgtatttttagtaagat

SEQ ID NO: 12460 - DNA, 20 bp, Artificial Sequence
  Description of Artificial Sequence: Synthetic oligonucleotide
  Target: SOD1; (-) strand; PAM type: YTN; PAM sequence: TTG
ggctctggtgtatttttagt

SEQ ID NO: 12461 - DNA, 20 bp, Artificial Sequence
  Description of Artificial Sequence: Synthetic oligonucleotide
  Target: SOD1; (-) strand; PAM type: YTN; PAM sequence: TTG
gtcggaggttgggctctggt

SEQ ID NO: 12462 - DNA, 20 bp, Artificial Sequence
  Description of Artificial Sequence: Synthetic oligonucleotide
  Target: SOD1; (-) strand; PAM type: YTN; PAM sequence: TTG
atgtaattggtcggaggttg

SEQ ID NO: 12463 - DNA, 20 bp, Artificial Sequence
  Description of Artificial Sequence: Synthetic oligonucleotide
  Target: SOD1; (-) strand; PAM type: YTN; PAM sequence: TTT
gatgtaattggtcggaggtt

SEQ ID NO: 12464 - DNA, 20 bp, Artificial Sequence
  Description of Artificial Sequence: Synthetic oligonucleotide
  Target: SOD1; (-) strand; PAM type: YTN; PAM sequence: TTT
tgatgtaattggtcggaggt

SEQ ID NO: 12465 - DNA, 20 bp, Artificial Sequence
  Description of Artificial Sequence: Synthetic oligonucleotide
  Target: SOD1; (-) strand; PAM type: YTN; PAM sequence: CTA
ggacaggttttgatgtaatt

SEQ ID NO: 12466 - DNA, 20 bp, Artificial Sequence
  Description of Artificial Sequence: Synthetic oligonucleotide
  Target: SOD1; (-) strand; PAM type: YTN; PAM sequence: CTG
cactaggacaggttttgatg

SEQ ID NO: 12467 - DNA, 20 bp, Artificial Sequence
  Description of Artificial Sequence: Synthetic oligonucleotide
  Target: SOD1; (-) strand; PAM type: YTN; PAM sequence: CTC
accctgcactaggacaggtt

SEQ ID NO: 12468 - DNA, 20 bp, Artificial Sequence
  Description of Artificial Sequence: Synthetic oligonucleotide
  Target: SOD1; (-) strand; PAM type: YTN; PAM sequence: TTC
aaaaaacagcaatactcacc

SEQ ID NO: 12469 - DNA, 20 bp, Artificial Sequence
  Description of Artificial Sequence: Synthetic oligonucleotide
  Target: SOD1; (-) strand; PAM type: YTN; PAM sequence: TTT
caaaaaacagcaatactcac

SEQ ID NO: 12470 - DNA, 20 bp, Artificial Sequence
  Description of Artificial Sequence: Synthetic oligonucleotide
  Target: SOD1; (-) strand; PAM type: YTN; PAM sequence: CTT
tcaaaaaacagcaatactca

SEQ ID NO: 12471 - DNA, 20 bp, Artificial Sequence
  Description of Artificial Sequence: Synthetic oligonucleotide
  Target: SOD1; (-) strand; PAM type: YTN; PAM sequence: TTG
gaaactttcaaaaaacagca

SEQ ID NO: 12472 - DNA, 20 bp, Artificial Sequence
  Description of Artificial Sequence: Synthetic oligonucleotide
  Target: SOD1; (-) strand; PAM type: YTN; PAM sequence: TTT
ggaaactttcaaaaaacagc

SEQ ID NO: 12473 - DNA, 20 bp, Artificial Sequence
  Description of Artificial Sequence: Synthetic oligonucleotide
  Target: SOD1; (-) strand; PAM type: YTN; PAM sequence: TTT
tggaaactttcaaaaaacag

SEQ ID NO: 12474 - DNA, 20 bp, Artificial Sequence
  Description of Artificial Sequence: Synthetic oligonucleotide
  Target: SOD1; (-) strand; PAM type: YTN; PAM sequence: CTT
ttggaaactttcaaaaaaca

SEQ ID NO: 12475 - DNA, 20 bp, Artificial Sequence
  Description of Artificial Sequence: Synthetic oligonucleotide
  Target: SOD1; (-) strand; PAM type: YTN; PAM sequence: CTC
aatcgtaggtgcacatcaaa

SEQ ID NO: 12476 - DNA, 20 bp, Artificial Sequence
  Description of Artificial Sequence: Synthetic oligonucleotide
  Target: SOD1; (-) strand; PAM type: YTN; PAM sequence: TTC
tcaatcgtaggtgcacatca

SEQ ID NO: 12477 - DNA, 20 bp, Artificial Sequence
  Description of Artificial Sequence: Synthetic oligonucleotide
  Target: SOD1; (-) strand; PAM type: YTN; PAM sequence: CTC
aaacgacagttctcaatcgt

SEQ ID NO: 12478 - DNA, 20 bp, Artificial Sequence
  Description of Artificial Sequence: Synthetic oligonucleotide
  Target: SOD1; (-) strand; PAM type: YTN; PAM sequence: CTG
tcctcaaacgacagttctca

SEQ ID NO: 12479 - DNA, 20 bp, Artificial Sequence
  Description of Artificial Sequence: Synthetic oligonucleotide
  Target: SOD1; (-) strand; PAM type: YTN; PAM sequence: CTC
cacccactgtcctcaaacga

SEQ ID NO: 12480 - DNA, 20 bp, Artificial Sequence
  Description of Artificial Sequence: Synthetic oligonucleotide
  Target: SOD1; (-) strand; PAM type: YTN; PAM sequence: TTC
caaatacgaaactccaccca

SEQ ID NO: 12481 - DNA, 20 bp, Artificial Sequence
  Description of Artificial Sequence: Synthetic oligonucleotide
  Target: SOD1; (-) strand; PAM type: YTN; PAM sequence: TTT
ccaaatacgaaactccaccc

SEQ ID NO: 12482 - DNA, 20 bp, Artificial Sequence
  Description of Artificial Sequence: Synthetic oligonucleotide
  Target: SOD1; (-) strand; PAM type: YTN; PAM sequence: CTA
atttccaaatacgaaactcc

SEQ ID NO: 12483 - DNA, 20 bp, Artificial Sequence
  Description of Artificial Sequence: Synthetic oligonucleotide
  Target: SOD1; (-) strand; PAM type: YTN; PAM sequence: TTC
taatttccaaatacgaaact

SEQ ID NO: 12484 - DNA, 20 bp, Artificial Sequence
  Description of Artificial Sequence: Synthetic oligonucleotide
  Target: SOD1; (-) strand; PAM type: YTN; PAM sequence: CTT
ctaatttccaaatacgaaac

SEQ ID NO: 12485 - DNA, 20 bp, Artificial Sequence
  Description of Artificial Sequence: Synthetic oligonucleotide
  Target: SOD1; (-) strand; PAM type: YTN; PAM sequence: CTC
caggtcttctaatttccaaa

SEQ ID NO: 12486 - DNA, 20 bp, Artificial Sequence
  Description of Artificial Sequence: Synthetic oligonucleotide
  Target: SOD1; (-) strand; PAM type: YTN; PAM sequence: TTC
ggtgtaatggaaactccagg

SEQ ID NO: 12487 - DNA, 20 bp, Artificial Sequence
  Description of Artificial Sequence: Synthetic oligonucleotide
  Target: SOD1; (-) strand; PAM type: YTN; PAM sequence: TTA
agtgccaattcggtgtaatg

SEQ ID NO: 12488 - DNA, 20 bp, Artificial Sequence
  Description of Artificial Sequence: Synthetic oligonucleotide
  Target: SOD1; (-) strand; PAM type: YTN; PAM sequence: TTA
ttaagtgccaattcggtgta

SEQ ID NO: 12489 - DNA, 20 bp, Artificial Sequence
  Description of Artificial Sequence: Synthetic oligonucleotide
  Target: SOD1; (-) strand; PAM type: YTN; PAM sequence: CTC
cgacaacagttattaagtgc

SEQ ID NO: 12490 - DNA, 20 bp, Artificial Sequence
  Description of Artificial Sequence: Synthetic oligonucleotide
  Target: SOD1; (-) strand; PAM type: YTN; PAM sequence: TTA
agaaatgctccgacaacagt

SEQ ID NO: 12491 - DNA, 20 bp, Artificial Sequence
  Description of Artificial Sequence: Synthetic oligonucleotide
  Target: SOD1; (-) strand; PAM type: YTN; PAM sequence: CTT
aagaaatgctccgacaacag

SEQ ID NO: 12492 - DNA, 20 bp, Artificial Sequence
  Description of Artificial Sequence: Synthetic oligonucleotide
  Target: SOD1; (-) strand; PAM type: YTN; PAM sequence: TTA
cgaaaatgtggcttaagaaa

SEQ ID NO: 12493 - DNA, 20 bp, Artificial Sequence
  Description of Artificial Sequence: Synthetic oligonucleotide
  Target: SOD1; (-) strand; PAM type: YTN; PAM sequence: TTT
acgaaaatgtggcttaagaa

SEQ ID NO: 12494 - DNA, 20 bp, Artificial Sequence
  Description of Artificial Sequence: Synthetic oligonucleotide
  Target: SOD1; (-) strand; PAM type: YTN; PAM sequence: CTT
tacgaaaatgtggcttaaga

SEQ ID NO: 12495 - DNA, 20 bp, Artificial Sequence
  Description of Artificial Sequence: Synthetic oligonucleotide
  Target: SOD1; (-) strand; PAM type: YTN; PAM sequence: TTA
aagccactttacgaaaatgt

SEQ ID NO: 12496 - DNA, 20 bp, Artificial Sequence
  Description of Artificial Sequence: Synthetic oligonucleotide
  Target: SOD1; (-) strand; PAM type: YTN; PAM sequence: TTT
aaagccactttacgaaaatg

SEQ ID NO: 12497 - DNA, 20 bp, Artificial Sequence
  Description of Artificial Sequence: Synthetic oligonucleotide
  Target: SOD1; (-) strand; PAM type: YTN; PAM sequence: TTT
taaagccactttacgaaaat

SEQ ID NO: 12498 - DNA, 20 bp, Artificial Sequence
  Description of Artificial Sequence: Synthetic oligonucleotide
  Target: SOD1; (-) strand; PAM type: YTN; PAM sequence: CTG
gcagagcaattttaaagcca

SEQ ID NO: 12499 - DNA, 20 bp, Artificial Sequence
  Description of Artificial Sequence: Synthetic oligonucleotide
  Target: SOD1; (-) strand; PAM type: YTN; PAM sequence: CTA
ctggcagagcaattttaaag

SEQ ID NO: 12500 - DNA, 20 bp, Artificial Sequence
  Description of Artificial Sequence: Synthetic oligonucleotide
  Target: SOD1; (-) strand; PAM type: YTN; PAM sequence: CTG
cctactggcagagcaatttt

SEQ ID NO: 12501 - DNA, 20 bp, Artificial Sequence
  Description of Artificial Sequence: Synthetic oligonucleotide
  Target: SOD1; (-) strand; PAM type: YTN; PAM sequence: TTA
gcaacctgcctactggcaga

SEQ ID NO: 12502 - DNA, 20 bp, Artificial Sequence
  Description of Artificial Sequence: Synthetic oligonucleotide
  Target: SOD1; (-) strand; PAM type: YTN; PAM sequence: CTT
agcaacctgcctactggcag

SEQ ID NO: 12503 - DNA, 20 bp, Artificial Sequence
  Description of Artificial Sequence: Synthetic oligonucleotide
  Target: SOD1; (-) strand; PAM type: YTN; PAM sequence: CTG
accatcttagcaacctgcct

SEQ ID NO: 12504 - DNA, 20 bp, Artificial Sequence
  Description of Artificial Sequence: Synthetic oligonucleotide
  Target: SOD1; (-) strand; PAM type: YTN; PAM sequence: CTC
tgaccatcttagcaacctgc

SEQ ID NO: 12505 - DNA, 20 bp, Artificial Sequence
  Description of Artificial Sequence: Synthetic oligonucleotide
  Target: SOD1; (-) strand; PAM type: YTN; PAM sequence: TTG
tctctgaccatcttagcaac

SEQ ID NO: 12506 - DNA, 20 bp, Artificial Sequence
  Description of Artificial Sequence: Synthetic oligonucleotide
  Target: SOD1; (-) strand; PAM type: YTN; PAM sequence: TTT
gtctctgaccatcttagcaa

SEQ ID NO: 12507 - DNA, 20 bp, Artificial Sequence
  Description of Artificial Sequence: Synthetic oligonucleotide
  Target: SOD1; (-) strand; PAM type: YTN; PAM sequence: TTC
agaagtttgtctctgaccat

SEQ ID NO: 12508 - DNA, 20 bp, Artificial Sequence
  Description of Artificial Sequence: Synthetic oligonucleotide
  Target: SOD1; (-) strand; PAM type: YTN; PAM sequence: TTA
caagagtcgttcagaagttt

SEQ ID NO: 12509 - DNA, 20 bp, Artificial Sequence
  Description of Artificial Sequence: Synthetic oligonucleotide
  Target: SOD1; (-) strand; PAM type: YTN; PAM sequence: TTT
acaagagtcgttcagaagtt

SEQ ID NO: 12510 - DNA, 20 bp, Artificial Sequence
  Description of Artificial Sequence: Synthetic oligonucleotide
  Target: SOD1; (-) strand; PAM type: YTN; PAM sequence: TTT
tacaagagtcgttcagaagt

SEQ ID NO: 12511 - DNA, 20 bp, Artificial Sequence
  Description of Artificial Sequence: Synthetic oligonucleotide
  Target: SOD1; (-) strand; PAM type: YTN; PAM sequence: CTG
tatattttacaagagtcgtt

SEQ ID NO: 12512 - DNA, 20 bp, Artificial Sequence
  Description of Artificial Sequence: Synthetic oligonucleotide
  Target: SOD1; (-) strand; PAM type: YTN; PAM sequence: TTC
tgtatattttacaagagtcg

SEQ ID NO: 12513 - DNA, 20 bp, Artificial Sequence
  Description of Artificial Sequence: Synthetic oligonucleotide
  Target: SOD1; (-) strand; PAM type: YTN; PAM sequence: TTT
ctgtatattttacaagagtc

SEQ ID NO: 12514 - DNA, 20 bp, Artificial Sequence
  Description of Artificial Sequence: Synthetic oligonucleotide
  Target: SOD1; (-) strand; PAM type: YTN; PAM sequence: CTG
aaaatatttctgtatatttt

SEQ ID NO: 12515 - DNA, 20 bp, Artificial Sequence
  Description of Artificial Sequence: Synthetic oligonucleotide
  Target: SOD1; (-) strand; PAM type: YTN; PAM sequence: TTC
tgaaaatatttctgtatatt

SEQ ID NO: 12516 - DNA, 20 bp, Artificial Sequence
  Description of Artificial Sequence: Synthetic oligonucleotide
  Target: SOD1; (-) strand; PAM type: YTN; PAM sequence: CTG
ataaaagttctgaaaatatt

SEQ ID NO: 12517 - DNA, 20 bp, Artificial Sequence
  Description of Artificial Sequence: Synthetic oligonucleotide
  Target: SOD1; (-) strand; PAM type: YTN; PAM sequence: TTA
ctgataaaagttctgaaaat

SEQ ID NO: 12518 - DNA, 20 bp, Artificial Sequence
  Description of Artificial Sequence: Synthetic oligonucleotide
  Target: SOD1; (-) strand; PAM type: YTN; PAM sequence: TTT
actgataaaagttctgaaaa

SEQ ID NO: 12519 - DNA, 20 bp, Artificial Sequence
  Description of Artificial Sequence: Synthetic oligonucleotide
  Target: SOD1; (-) strand; PAM type: YTN; PAM sequence: TTT
tactgataaaagttctgaaa

SEQ ID NO: 12520 - DNA, 20 bp, Artificial Sequence
  Description of Artificial Sequence: Synthetic oligonucleotide
  Target: SOD1; (-) strand; PAM type: YTN; PAM sequence: TTG
taattttactgataaaagtt

SEQ ID NO: 12521 - DNA, 20 bp, Artificial Sequence
  Description of Artificial Sequence: Synthetic oligonucleotide
  Target: SOD1; (-) strand; PAM type: YTN; PAM sequence: TTT
gtaattttactgataaaagt

SEQ ID NO: 12522 - DNA, 20 bp, Artificial Sequence
  Description of Artificial Sequence: Synthetic oligonucleotide
  Target: SOD1; (-) strand; PAM type: YTN; PAM sequence: TTT
tgtaattttactgataaaag

SEQ ID NO: 12523 - DNA, 20 bp, Artificial Sequence
  Description of Artificial Sequence: Synthetic oligonucleotide
  Target: SOD1; (-) strand; PAM type: YTN; PAM sequence: TTG
caacacgttttgtaatttta

SEQ ID NO: 12524 - DNA, 20 bp, Artificial Sequence
  Description of Artificial Sequence: Synthetic oligonucleotide
  Target: SOD1; (-) strand; PAM type: YTN; PAM sequence: CTT
gcaacacgttttgtaatttt

SEQ ID NO: 12525 - DNA, 20 bp, Artificial Sequence
  Description of Artificial Sequence: Synthetic oligonucleotide
  Target: SOD1; (-) strand; PAM type: YTN; PAM sequence: TTC
cttgcaacacgttttgtaat

SEQ ID NO: 12526 - DNA, 20 bp, Artificial Sequence
  Description of Artificial Sequence: Synthetic oligonucleotide
  Target: SOD1; (-) strand; PAM type: YTN; PAM sequence: CTT
ccttgcaacacgttttgtaa

SEQ ID NO: 12527 - DNA, 20 bp, Artificial Sequence
  Description of Artificial Sequence: Synthetic oligonucleotide
  Target: SOD1; (-) strand; PAM type: YTN; PAM sequence: TTA
tcacaagcaccttccttgca

SEQ ID NO: 12528 - DNA, 20 bp, Artificial Sequence
  Description of Artificial Sequence: Synthetic oligonucleotide
  Target: SOD1; (-) strand; PAM type: YTN; PAM sequence: CTG
gggacagtgttatcacaagc

SEQ ID NO: 12529 - DNA, 20 bp, Artificial Sequence
  Description of Artificial Sequence: Synthetic oligonucleotide
  Target: SOD1; (-) strand; PAM type: YTN; PAM sequence: TTC
tggggacagtgttatcacaa

SEQ ID NO: 12530 - DNA, 20 bp, Artificial Sequence
  Description of Artificial Sequence: Synthetic oligonucleotide
  Target: SOD1; (-) strand; PAM type: YTN; PAM sequence: CTA
aggttctggggacagtgtta

SEQ ID NO: 12531 - DNA, 20 bp, Artificial Sequence
  Description of Artificial Sequence: Synthetic oligonucleotide
  Target: SOD1; (-) strand; PAM type: YTN; PAM sequence: TTC
actaaggttctggggacagt

SEQ ID NO: 12532 - DNA, 20 bp, Artificial Sequence
  Description of Artificial Sequence: Synthetic oligonucleotide
  Target: SOD1; (-) strand; PAM type: YTN; PAM sequence: CTT
cactaaggttctggggacag

SEQ ID NO: 12533 - DNA, 20 bp, Artificial Sequence
  Description of Artificial Sequence: Synthetic oligonucleotide
  Target: SOD1; (-) strand; PAM type: YTN; PAM sequence: TTG
gtaacttcactaaggttctg

SEQ ID NO: 12534 - DNA, 20 bp, Artificial Sequence
  Description of Artificial Sequence: Synthetic oligonucleotide
  Target: SOD1; (-) strand; PAM type: YTN; PAM sequence: TTC
caccagttggtaacttcact

SEQ ID NO: 12535 - DNA, 20 bp, Artificial Sequence
  Description of Artificial Sequence: Synthetic oligonucleotide
  Target: SOD1; (-) strand; PAM type: YTN; PAM sequence: TTT
ccaccagttggtaacttcac

SEQ ID NO: 12536 - DNA, 20 bp, Artificial Sequence
  Description of Artificial Sequence: Synthetic oligonucleotide
  Target: SOD1; (-) strand; PAM type: YTN; PAM sequence: TTT
tccaccagttggtaacttca

SEQ ID NO: 12537 - DNA, 20 bp, Artificial Sequence
  Description of Artificial Sequence: Synthetic oligonucleotide
  Target: SOD1; (-) strand; PAM type: YTN; PAM sequence: TTA
agccgagtgcaagagaaaat

SEQ ID NO: 12538 - DNA, 20 bp, Artificial Sequence
  Description of Artificial Sequence: Synthetic oligonucleotide
  Target: SOD1; (-) strand; PAM type: YTN; PAM sequence: TTT
aagccgagtgcaagagaaaa

SEQ ID NO: 12539 - DNA, 20 bp, Artificial Sequence
  Description of Artificial Sequence: Synthetic oligonucleotide
  Target: SOD1; (-) strand; PAM type: YTN; PAM sequence: TTT
taagccgagtgcaagagaaa

SEQ ID NO: 12540 - DNA, 20 bp, Artificial Sequence
  Description of Artificial Sequence: Synthetic oligonucleotide
  Target: SOD1; (-) strand; PAM type: YTN; PAM sequence: TTT
ttaagccgagtgcaagagaa

SEQ ID NO: 12541 - DNA, 20 bp, Artificial Sequence
  Description of Artificial Sequence: Synthetic oligonucleotide
  Target: SOD1; (-) strand; PAM type: YTN; PAM sequence: CTC
atgatttttaagccgagtgc

SEQ ID NO: 12542 - DNA, 20 bp, Artificial Sequence
  Description of Artificial Sequence: Synthetic oligonucleotide
  Target: SOD1; (-) strand; PAM type: YTN; PAM sequence: TTC
cctcatgatttttaagccga

SEQ ID NO: 12543 - DNA, 20 bp, Artificial Sequence
  Description of Artificial Sequence: Synthetic oligonucleotide
  Target: SOD1; (-) strand; PAM type: YTN; PAM sequence: TTC
gtatagtaaatattccctca

SEQ ID NO: 12544 - DNA, 20 bp, Artificial Sequence
  Description of Artificial Sequence: Synthetic oligonucleotide
  Target: SOD1; (-) strand; PAM type: YTN; PAM sequence: CTC
attcgtatagtaaatattcc

SEQ ID NO: 12545 - DNA, 20 bp, Artificial Sequence
  Description of Artificial Sequence: Synthetic oligonucleotide
  Target: SOD1; (-) strand; PAM type: YTN; PAM sequence: CTG
aatctcattcgtatagtaaa

SEQ ID NO: 12546 - DNA, 20 bp, Artificial Sequence
  Description of Artificial Sequence: Synthetic oligonucleotide
  Target: SOD1; (-) strand; PAM type: YTN; PAM sequence: TTA
aagactgaatctcattcgta

SEQ ID NO: 12547 - DNA, 20 bp, Artificial Sequence
  Description of Artificial Sequence: Synthetic oligonucleotide
  Target: SOD1; (-) strand; PAM type: YTN; PAM sequence: TTT
aaagactgaatctcattcgt

SEQ ID NO: 12548 - DNA, 20 bp, Artificial Sequence
  Description of Artificial Sequence: Synthetic oligonucleotide
  Target: SOD1; (-) strand; PAM type: YTN; PAM sequence: CTT
taaagactgaatctcattcg

SEQ ID NO: 12549 - DNA, 20 bp, Artificial Sequence
  Description of Artificial Sequence: Synthetic oligonucleotide
  Target: SOD1; (-) strand; PAM type: YTN; PAM sequence: CTG
taaacccctttaaagactga

SEQ ID NO: 12550 - DNA, 20 bp, Artificial Sequence
  Description of Artificial Sequence: Synthetic oligonucleotide
  Target: SOD1; (-) strand; PAM type: YTN; PAM sequence: TTC
tgtaaacccctttaaagact

SEQ ID NO: 12551 - DNA, 20 bp, Artificial Sequence
  Description of Artificial Sequence: Synthetic oligonucleotide
  Target: SOD1; (-) strand; PAM type: YTN; PAM sequence: TTT
ctgtaaacccctttaaagac

SEQ ID NO: 12552 - DNA, 20 bp, Artificial Sequence
  Description of Artificial Sequence: Synthetic oligonucleotide
  Target: SOD1; (-) strand; PAM type: YTN; PAM sequence: CTC
acgtttctgtaaaccccttt

SEQ ID NO: 12553 - DNA, 20 bp, Artificial Sequence
  Description of Artificial Sequence: Synthetic oligonucleotide
  Target: SOD1; (-) strand; PAM type: YTN; PAM sequence: CTC
tcacgtttctgtaaacccct

SEQ ID NO: 12554 - DNA, 20 bp, Artificial Sequence
  Description of Artificial Sequence: Synthetic oligonucleotide
  Target: SOD1; (-) strand; PAM type: YTN; PAM sequence: CTG
tcctctcacgtttctgtaaa

SEQ ID NO: 12555 - DNA, 20 bp, Artificial Sequence
  Description of Artificial Sequence: Synthetic oligonucleotide
  Target: SOD1; (-) strand; PAM type: YTN; PAM sequence: TTC
ctgtcctctcacgtttctgt

SEQ ID NO: 12556 - DNA, 20 bp, Artificial Sequence
  Description of Artificial Sequence: Synthetic oligonucleotide
  Target: SOD1; (-) strand; PAM type: YTN; PAM sequence: CTG
ttcctgtcctctcacgtttc

SEQ ID NO: 12557 - DNA, 20 bp, Artificial Sequence
  Description of Artificial Sequence: Synthetic oligonucleotide
  Target: SOD1; (-) strand; PAM type: YTN; PAM sequence: CTA
actgttcctgtcctctcacg

SEQ ID NO: 12558 - DNA, 20 bp, Artificial Sequence
  Description of Artificial Sequence: Synthetic oligonucleotide
  Target: SOD1; (-) strand; PAM type: YTN; PAM sequence: TTA
cacagactaactgttcctgt

SEQ ID NO: 12559 - DNA, 20 bp, Artificial Sequence
  Description of Artificial Sequence: Synthetic oligonucleotide
  Target: SOD1; (-) strand; PAM type: YTN; PAM sequence: TTT
acacagactaactgttcctg

SEQ ID NO: 12560 - DNA, 20 bp, Artificial Sequence
  Description of Artificial Sequence: Synthetic oligonucleotide
  Target: SOD1; (-) strand; PAM type: YTN; PAM sequence: TTC
agacatttacacagactaac

SEQ ID NO: 12561 - DNA, 20 bp, Artificial Sequence
  Description of Artificial Sequence: Synthetic oligonucleotide
  Target: SOD1; (-) strand; PAM type: YTN; PAM sequence: TTT
cagacatttacacagactaa

SEQ ID NO: 12562 - DNA, 20 bp, Artificial Sequence
  Description of Artificial Sequence: Synthetic oligonucleotide
  Target: SOD1; (-) strand; PAM type: YTN; PAM sequence: CTC
acatatatttcagacattta

SEQ ID NO: 12563 - DNA, 20 bp, Artificial Sequence
  Description of Artificial Sequence: Synthetic oligonucleotide
  Target: SOD1; (-) strand; PAM type: YTN; PAM sequence: CTC
cctcacatatatttcagaca

SEQ ID NO: 12564 - DNA, 20 bp, Artificial Sequence
  Description of Artificial Sequence: Synthetic oligonucleotide
  Target: SOD1; (-) strand; PAM type: YTN; PAM sequence: TTA
tctccctcacatatatttca

SEQ ID NO: 12565 - DNA, 20 bp, Artificial Sequence
  Description of Artificial Sequence: Synthetic oligonucleotide
  Target: SOD1; (-) strand; PAM type: YTN; PAM sequence: CTC
attatctccctcacatatat

SEQ ID NO: 12566 - DNA, 20 bp, Artificial Sequence
  Description of Artificial Sequence: Synthetic oligonucleotide
  Target: SOD1; (-) strand; PAM type: YTN; PAM sequence: CTA
aactcattatctccctcaca

SEQ ID NO: 12567 - DNA, 20 bp, Artificial Sequence
  Description of Artificial Sequence: Synthetic oligonucleotide
  Target: SOD1; (-) strand; PAM type: YTN; PAM sequence: TTA
aagaaaaaggctaaactcat

SEQ ID NO: 12568 - DNA, 20 bp, Artificial Sequence
  Description of Artificial Sequence: Synthetic oligonucleotide
  Target: SOD1; (-) strand; PAM type: YTN; PAM sequence: CTA
ttaaagaaaaaggctaaact

SEQ ID NO: 12569 - DNA, 20 bp, Artificial Sequence
  Description of Artificial Sequence: Synthetic oligonucleotide
  Target: SOD1; (-) strand; PAM type: YTN; PAM sequence: CTG
gagacctattaaagaaaaag

SEQ ID NO: 12570 - DNA, 20 bp, Artificial Sequence
  Description of Artificial Sequence: Synthetic oligonucleotide
  Target: SOD1; (-) strand; PAM type: YTN; PAM sequence: TTC
cagaaaatctggagacctat

SEQ ID NO: 12571 - DNA, 20 bp, Artificial Sequence
  Description of Artificial Sequence: Synthetic oligonucleotide
  Target: SOD1; (-) strand; PAM type: YTN; PAM sequence: TTT
ccagaaaatctggagaccta

SEQ ID NO: 12572 - DNA, 20 bp, Artificial Sequence
  Description of Artificial Sequence: Synthetic oligonucleotide
  Target: SOD1; (-) strand; PAM type: YTN; PAM sequence: TTT
tccagaaaatctggagacct

SEQ ID NO: 12573 - DNA, 20 bp, Artificial Sequence
  Description of Artificial Sequence: Synthetic oligonucleotide
  Target: SOD1; (-) strand; PAM type: YTN; PAM sequence: CTT
ttccagaaaatctggagacc

SEQ ID NO: 12574 - DNA, 20 bp, Artificial Sequence
  Description of Artificial Sequence: Synthetic oligonucleotide
  Target: SOD1; (-) strand; PAM type: YTN; PAM sequence: CTG
acaaatgaaacagcaaaatg

SEQ ID NO: 12575 - DNA, 20 bp, Artificial Sequence
  Description of Artificial Sequence: Synthetic oligonucleotide
  Target: SOD1; (-) strand; PAM type: YTN; PAM sequence: TTA
tgtggggagaagtaaagagg

SEQ ID NO: 12576 - DNA, 20 bp, Artificial Sequence
  Description of Artificial Sequence: Synthetic oligonucleotide
  Target: SOD1; (-) strand; PAM type: YTN; PAM sequence: CTG
gtgaattatgtggggagaag

SEQ ID NO: 12577 - DNA, 20 bp, Artificial Sequence
  Description of Artificial Sequence: Synthetic oligonucleotide
  Target: SOD1; (-) strand; PAM type: YTN; PAM sequence: CTA
gtactggtgaattatgtggg

SEQ ID NO: 12578 - DNA, 20 bp, Artificial Sequence
  Description of Artificial Sequence: Synthetic oligonucleotide
  Target: SOD1; (-) strand; PAM type: YTN; PAM sequence: CTG
aaaaacaaaacactagtact

SEQ ID NO: 12579 - DNA, 20 bp, Artificial Sequence
  Description of Artificial Sequence: Synthetic oligonucleotide
  Target: SOD1; (-) strand; PAM type: YTN; PAM sequence: TTG
gtctgaaaaacaaaacacta

SEQ ID NO: 12580 - DNA, 20 bp, Artificial Sequence
  Description of Artificial Sequence: Synthetic oligonucleotide
  Target: SOD1; (-) strand; PAM type: YTN; PAM sequence: CTT
ggtctgaaaaacaaaacact

SEQ ID NO: 12581 - DNA, 20 bp, Artificial Sequence
  Description of Artificial Sequence: Synthetic oligonucleotide
  Target: SOD1; (-) strand; PAM type: YTN; PAM sequence: CTG
ggcgacagagcgagacttgg

SEQ ID NO: 12582 - DNA, 20 bp, Artificial Sequence
  Description of Artificial Sequence: Synthetic oligonucleotide
  Target: SOD1; (-) strand; PAM type: YTN; PAM sequence: CTC
cagcctgggcgacagagcga

SEQ ID NO: 12583 - DNA, 20 bp, Artificial Sequence
  Description of Artificial Sequence: Synthetic oligonucleotide
  Target: SOD1; (-) strand; PAM type: YTN; PAM sequence: CTG
cactccagcctgggcgacag

SEQ ID NO: 12584 - DNA, 20 bp, Artificial Sequence
  Description of Artificial Sequence: Synthetic oligonucleotide
  Target: SOD1; (-) strand; PAM type: YTN; PAM sequence: CTG
agatcgcgccactgcactcc

SEQ ID NO: 12585 - DNA, 20 bp, Artificial Sequence
  Description of Artificial Sequence: Synthetic oligonucleotide
  Target: SOD1; (-) strand; PAM type: YTN; PAM sequence: TTG
cagtgagctgagatcgcgcc

SEQ ID NO: 12586 - DNA, 20 bp, Artificial Sequence
  Description of Artificial Sequence: Synthetic oligonucleotide
  Target: SOD1; (-) strand; PAM type: YTN; PAM sequence: CTG
ggaggcggaggttgcagtga

SEQ ID NO: 12587 - DNA, 20 bp, Artificial Sequence
  Description of Artificial Sequence: Synthetic oligonucleotide
  Target: SOD1; (-) strand; PAM type: YTN; PAM sequence: TTG
aacctgggaggcggaggttg

SEQ ID NO: 12588 - DNA, 20 bp, Artificial Sequence
  Description of Artificial Sequence: Synthetic oligonucleotide
  Target: SOD1; (-) strand; PAM type: YTN; PAM sequence: CTT
gaacctgggaggcggaggtt

SEQ ID NO: 12589 - DNA, 20 bp, Artificial Sequence
  Description of Artificial Sequence: Synthetic oligonucleotide
  Target: SOD1; (-) strand; PAM type: YTN; PAM sequence: TTG
cttgaacctgggaggcggag

SEQ ID NO: 12590 - DNA, 20 bp, Artificial Sequence
  Description of Artificial Sequence: Synthetic oligonucleotide
  Target: SOD1; (-) strand; PAM type: YTN; PAM sequence: CTG
aggcaggagaattgcttgaa

SEQ ID NO: 12591 - DNA, 20 bp, Artificial Sequence
  Description of Artificial Sequence: Synthetic oligonucleotide
  Target: SOD1; (-) strand; PAM type: YTN; PAM sequence: CTA
cccgggaggctgaggcagga

SEQ ID NO: 12592 - DNA, 20 bp, Artificial Sequence
  Description of Artificial Sequence: Synthetic oligonucleotide
  Target: SOD1; (-) strand; PAM type: YTN; PAM sequence: CTG
tagtcccagctacccgggag

SEQ ID NO: 12593 - DNA, 20 bp, Artificial Sequence
  Description of Artificial Sequence: Synthetic oligonucleotide
  Target: SOD1; (-) strand; PAM type: YTN; PAM sequence: TTA
gccaggcgtggcggcgcgcg

SEQ ID NO: 12594 - DNA, 20 bp, Artificial Sequence
  Description of Artificial Sequence: Synthetic oligonucleotide
  Target: SOD1; (-) strand; PAM type: YTN; PAM sequence: CTA
aaatataaaaaattagccag

SEQ ID NO: 12595 - DNA, 20 bp, Artificial Sequence
  Description of Artificial Sequence: Synthetic oligonucleotide
  Target: SOD1; (-) strand; PAM type: YTN; PAM sequence: CTA
ctaaaatataaaaaattagc

SEQ ID NO: 12596 - DNA, 20 bp, Artificial Sequence
  Description of Artificial Sequence: Synthetic oligonucleotide
  Target: SOD1; (-) strand; PAM type: YTN; PAM sequence: CTC
tactaaaatataaaaaatta

SEQ ID NO: 12597 - DNA, 20 bp, Artificial Sequence
  Description of Artificial Sequence: Synthetic oligonucleotide
  Target: SOD1; (-) strand; PAM type: YTN; PAM sequence: CTG
gccaacatggtgaaacgccg

SEQ ID NO: 12598 - DNA, 20 bp, Artificial Sequence
  Description of Artificial Sequence: Synthetic oligonucleotide
  Target: SOD1; (-) strand; PAM type: YTN; PAM sequence: TTG
ggaggccgaggcgggtggat

SEQ ID NO: 12599 - DNA, 20 bp, Artificial Sequence
  Description of Artificial Sequence: Synthetic oligonucleotide
  Target: SOD1; (-) strand; PAM type: YTN; PAM sequence: TTT
gggaggccgaggcgggtgga

SEQ ID NO: 12600 - DNA, 20 bp, Artificial Sequence
  Description of Artificial Sequence: Synthetic oligonucleotide
  Target: SOD1; (-) strand; PAM type: YTN; PAM sequence: CTT
tgggaggccgaggcgggtgg

SEQ ID NO: 12601 - DNA, 20 bp, Artificial Sequence
  Description of Artificial Sequence: Synthetic oligonucleotide
  Target: SOD1; (-) strand; PAM type: YTN; PAM sequence: CTG
taatcccagcactttgggag

SEQ ID NO: 12602 - DNA, 20 bp, Artificial Sequence
  Description of Artificial Sequence: Synthetic oligonucleotide
  Target: SOD1; (-) strand; PAM type: YTN; PAM sequence: CTC
acgcctgtaatcccagcact

SEQ ID NO: 12603 - DNA, 20 bp, Artificial Sequence
  Description of Artificial Sequence: Synthetic oligonucleotide
  Target: SOD1; (-) strand; PAM type: YTN; PAM sequence: CTG
gtggccgggcggggtggctc

SEQ ID NO: 12604 - DNA, 20 bp, Artificial Sequence
  Description of Artificial Sequence: Synthetic oligonucleotide
  Target: SOD1; (-) strand; PAM type: YTN; PAM sequence: TTA
agaatagcactggtggccgg

SEQ ID NO: 12605 - DNA, 20 bp, Artificial Sequence
  Description of Artificial Sequence: Synthetic oligonucleotide
  Target: SOD1; (-) strand; PAM type: YTN; PAM sequence: CTT
aagaatagcactggtggccg

SEQ ID NO: 12606 - DNA, 20 bp, Artificial Sequence
  Description of Artificial Sequence: Synthetic oligonucleotide
  Target: SOD1; (-) strand; PAM type: YTN; PAM sequence: CTC
agaggcgtcttaagaatagc

SEQ ID NO: 12607 - DNA, 20 bp, Artificial Sequence
  Description of Artificial Sequence: Synthetic oligonucleotide
  Target: SOD1; (-) strand; PAM type: YTN; PAM sequence: TTC
ctcagaggcgtcttaagaat

SEQ ID NO: 12608 - DNA, 20 bp, Artificial Sequence
  Description of Artificial Sequence: Synthetic oligonucleotide
  Target: SOD1; (-) strand; PAM type: YTN; PAM sequence: CTC
aatggccagggagaagggat

SEQ ID NO: 12609 - DNA, 20 bp, Artificial Sequence
  Description of Artificial Sequence: Synthetic oligonucleotide
  Target: SOD1; (-) strand; PAM type: YTN; PAM sequence: TTC
tcaatggccagggagaaggg

SEQ ID NO: 12610 - DNA, 20 bp, Artificial Sequence
  Description of Artificial Sequence: Synthetic oligonucleotide
  Target: SOD1; (-) strand; PAM type: YTN; PAM sequence: TTC
atgcatggattctcaatggc

SEQ ID NO: 12611 - DNA, 20 bp, Artificial Sequence
  Description of Artificial Sequence: Synthetic oligonucleotide
  Target: SOD1; (-) strand; PAM type: YTN; PAM sequence: CTG
ggttcatgcatggattctca

SEQ ID NO: 12612 - DNA, 20 bp, Artificial Sequence
  Description of Artificial Sequence: Synthetic oligonucleotide
  Target: SOD1; (-) strand; PAM type: YTN; PAM sequence: CTC
agggaaggtggaaaacctgg

SEQ ID NO: 12613 - DNA, 20 bp, Artificial Sequence
  Description of Artificial Sequence: Synthetic oligonucleotide
  Target: SOD1; (-) strand; PAM type: YTN; PAM sequence: CTG
ctcagggaaggtggaaaacc

SEQ ID NO: 12614 - DNA, 20 bp, Artificial Sequence
  Description of Artificial Sequence: Synthetic oligonucleotide
  Target: SOD1; (-) strand; PAM type: YTN; PAM sequence: CTA
tgcaagctgctcagggaagg

SEQ ID NO: 12615 - DNA, 20 bp, Artificial Sequence
  Description of Artificial Sequence: Synthetic oligonucleotide
  Target: SOD1; (-) strand; PAM type: YTN; PAM sequence: TTA
aaagaaggaactatgcaagc

SEQ ID NO: 12616 - DNA, 20 bp, Artificial Sequence
  Description of Artificial Sequence: Synthetic oligonucleotide
  Target: SOD1; (-) strand; PAM type: YTN; PAM sequence: CTT
aaaagaaggaactatgcaag

SEQ ID NO: 12617 - DNA, 20 bp, Artificial Sequence
  Description of Artificial Sequence: Synthetic oligonucleotide
  Target: SOD1; (-) strand; PAM type: YTN; PAM sequence: CTC
aggtacaacgggcaccaaac

SEQ ID NO: 12618 - DNA, 20 bp, Artificial Sequence
  Description of Artificial Sequence: Synthetic oligonucleotide
  Target: SOD1; (-) strand; PAM type: YTN; PAM sequence: TTC
tcaggtacaacgggcaccaa

SEQ ID NO: 12619 - DNA, 20 bp, Artificial Sequence
  Description of Artificial Sequence: Synthetic oligonucleotide
  Target: SOD1; (-) strand; PAM type: YTN; PAM sequence: CTC
attctcaggtacaacgggca

SEQ ID NO: 12620 - DNA, 20 bp, Artificial Sequence
  Description of Artificial Sequence: Synthetic oligonucleotide
  Target: SOD1; (-) strand; PAM type: YTN; PAM sequence: CTA
tccaaggctcattctcaggt

SEQ ID NO: 12621 - DNA, 20 bp, Artificial Sequence
  Description of Artificial Sequence: Synthetic oligonucleotide
  Target: SOD1; (-) strand; PAM type: YTN; PAM sequence: CTC
cactatccaaggctcattct

SEQ ID NO: 12622 - DNA, 20 bp, Artificial Sequence
  Description of Artificial Sequence: Synthetic oligonucleotide
  Target: SOD1; (-) strand; PAM type: YTN; PAM sequence: CTG
gaatgctccactatccaagg

SEQ ID NO: 12623 - DNA, 20 bp, Artificial Sequence
  Description of Artificial Sequence: Synthetic oligonucleotide
  Target: SOD1; (-) strand; PAM type: YTN; PAM sequence: CTG
gaaagctggaatgctccact

SEQ ID NO: 12624 - DNA, 20 bp, Artificial Sequence
  Description of Artificial Sequence: Synthetic oligonucleotide
  Target: SOD1; (-) strand; PAM type: YTN; PAM sequence: CTG
catatctggaaagctggaat

SEQ ID NO: 12625 - DNA, 20 bp, Artificial Sequence
  Description of Artificial Sequence: Synthetic oligonucleotide
  Target: SOD1; (-) strand; PAM type: YTN; PAM sequence: CTC
tgcatatctggaaagctgga

SEQ ID NO: 12626 - DNA, 20 bp, Artificial Sequence
  Description of Artificial Sequence: Synthetic oligonucleotide
  Target: SOD1; (-) strand; PAM type: YTN; PAM sequence: TTA
tctctgcatatctggaaagc

SEQ ID NO: 12627 - DNA, 20 bp, Artificial Sequence
  Description of Artificial Sequence: Synthetic oligonucleotide
  Target: SOD1; (-) strand; PAM type: YTN; PAM sequence: CTG
atagccaatgtattatctct

SEQ ID NO: 12628 - DNA, 20 bp, Artificial Sequence
  Description of Artificial Sequence: Synthetic oligonucleotide
  Target: SOD1; (-) strand; PAM type: YTN; PAM sequence: TTA
aacacggaataggccaagcc

SEQ ID NO: 12629 - DNA, 20 bp, Artificial Sequence
  Description of Artificial Sequence: Synthetic oligonucleotide
  Target: SOD1; (-) strand; PAM type: YTN; PAM sequence: TTT
aaacacggaataggccaagc

SEQ ID NO: 12630 - DNA, 20 bp, Artificial Sequence
  Description of Artificial Sequence: Synthetic oligonucleotide
  Target: SOD1; (-) strand; PAM type: YTN; PAM sequence: TTT
taaacacggaataggccaag

SEQ ID NO: 12631 - DNA, 20 bp, Artificial Sequence
  Description of Artificial Sequence: Synthetic oligonucleotide
  Target: SOD1; (-) strand; PAM type: YTN; PAM sequence: CTA
gcaaagagtccaagatttta

SEQ ID NO: 12632 - DNA, 20 bp, Artificial Sequence
  Description of Artificial Sequence: Synthetic oligonucleotide
  Target: SOD1; (-) strand; PAM type: YTN; PAM sequence: CTG
taaaaactagcaaagagtcc

SEQ ID NO: 12633 - DNA, 20 bp, Artificial Sequence
  Description of Artificial Sequence: Synthetic oligonucleotide
  Target: SOD1; (-) strand; PAM type: YTN; PAM sequence: CTG
atctgtaaaaactagcaaag

SEQ ID NO: 12634 - DNA, 20 bp, Artificial Sequence
  Description of Artificial Sequence: Synthetic oligonucleotide
  Target: SOD1; (-) strand; PAM type: YTN; PAM sequence: TTC
tgatctgtaaaaactagcaa

SEQ ID NO: 12635 - DNA, 20 bp, Artificial Sequence
  Description of Artificial Sequence: Synthetic oligonucleotide
  Target: SOD1; (-) strand; PAM type: YTN; PAM sequence: TTA
atacgtgaaaaattctgatc

SEQ ID NO: 12636 - DNA, 20 bp, Artificial Sequence
  Description of Artificial Sequence: Synthetic oligonucleotide
  Target: SOD1; (-) strand; PAM type: YTN; PAM sequence: CTG
gattaatacgtgaaaaattc

SEQ ID NO: 12637 - DNA, 20 bp, Artificial Sequence
  Description of Artificial Sequence: Synthetic oligonucleotide
  Target: SOD1; (-) strand; PAM type: YTN; PAM sequence: CTA
ggaaaactggattaatacgt

SEQ ID NO: 12638 - DNA, 20 bp, Artificial Sequence
  Description of Artificial Sequence: Synthetic oligonucleotide
  Target: SOD1; (-) strand; PAM type: YTN; PAM sequence: TTC
aagagaagctaggaaaactg

SEQ ID NO: 12639 - DNA, 20 bp, Artificial Sequence
  Description of Artificial Sequence: Synthetic oligonucleotide
  Target: SOD1; (-) strand; PAM type: YTN; PAM sequence: CTT
caagagaagctaggaaaact

SEQ ID NO: 12640 - DNA, 20 bp, Artificial Sequence
  Description of Artificial Sequence: Synthetic oligonucleotide
  Target: SOD1; (-) strand; PAM type: YTN; PAM sequence: TTC
ttcaagagaagctaggaaaa

SEQ ID NO: 12641 - DNA, 20 bp, Artificial Sequence
  Description of Artificial Sequence: Synthetic oligonucleotide
  Target: SOD1; (-) strand; PAM type: YTN; PAM sequence: CTC
caaaaattcttcaagagaag

SEQ ID NO: 12642 - DNA, 20 bp, Artificial Sequence
  Description of Artificial Sequence: Synthetic oligonucleotide
  Target: SOD1; (-) strand; PAM type: YTN; PAM sequence: CTC
agtatgaagagatctccaaa

SEQ ID NO: 12643 - DNA, 20 bp, Artificial Sequence
  Description of Artificial Sequence: Synthetic oligonucleotide
  Target: SOD1; (-) strand; PAM type: YTN; PAM sequence: CTA
atgaaggctcagtatgaaga

SEQ ID NO: 12644 - DNA, 20 bp, Artificial Sequence
  Description of Artificial Sequence: Synthetic oligonucleotide
  Target: SOD1; (-) strand; PAM type: YTN; PAM sequence: CTG
ggctaatgaaggctcagtat

SEQ ID NO: 12645 - DNA, 20 bp, Artificial Sequence
  Description of Artificial Sequence: Synthetic oligonucleotide
  Target: SOD1; (-) strand; PAM type: YTN; PAM sequence: CTG
tcctgggctaatgaaggctc

SEQ ID NO: 12646 - DNA, 20 bp, Artificial Sequence
  Description of Artificial Sequence: Synthetic oligonucleotide
  Target: SOD1; (-) strand; PAM type: YTN; PAM sequence: CTA
cagcagtactgtcctgggct

SEQ ID NO: 12647 - DNA, 20 bp, Artificial Sequence
  Description of Artificial Sequence: Synthetic oligonucleotide
  Target: SOD1; (-) strand; PAM type: YTN; PAM sequence: CTG
ctacagcagtactgtcctgg

SEQ ID NO: 12648 - DNA, 20 bp, Artificial Sequence
  Description of Artificial Sequence: Synthetic oligonucleotide
  Target: SOD1; (-) strand; PAM type: YTN; PAM sequence: CTG
ggaagcgaaaaaatatatga

SEQ ID NO: 12649 - DNA, 20 bp, Artificial Sequence
  Description of Artificial Sequence: Synthetic oligonucleotide
  Target: SOD1; (-) strand; PAM type: YTN; PAM sequence: TTA
agtgaataacacaggcctgg

SEQ ID NO: 12650 - DNA, 20 bp, Artificial Sequence
  Description of Artificial Sequence: Synthetic oligonucleotide
  Target: SOD1; (-) strand; PAM type: YTN; PAM sequence: CTT
aagtgaataacacaggcctg

SEQ ID NO: 12651 - DNA, 20 bp, Artificial Sequence
  Description of Artificial Sequence: Synthetic oligonucleotide
  Target: SOD1; (-) strand; PAM type: YTN; PAM sequence: CTA
tgaacttaagtgaataacac

SEQ ID NO: 12652 - DNA, 20 bp, Artificial Sequence
  Description of Artificial Sequence: Synthetic oligonucleotide
  Target: SOD1; (-) strand; PAM type: YTN; PAM sequence: CTG
cagggaccaggctatgaact

SEQ ID NO: 12653 - DNA, 20 bp, Artificial Sequence
  Description of Artificial Sequence: Synthetic oligonucleotide
  Target: SOD1; (-) strand; PAM type: YTN; PAM sequence: CTC
gggtacaaccctgcagggac

SEQ ID NO: 12654 - DNA, 20 bp, Artificial Sequence
  Description of Artificial Sequence: Synthetic oligonucleotide
  Target: SOD1; (-) strand; PAM type: YTN; PAM sequence: CTG
tgctcgggtacaaccctgca

SEQ ID NO: 12655 - DNA, 20 bp, Artificial Sequence
  Description of Artificial Sequence: Synthetic oligonucleotide
  Target: SOD1; (-) strand; PAM type: YTN; PAM sequence: CTA
agtagctgtgctcgggtaca

SEQ ID NO: 12656 - DNA, 20 bp, Artificial Sequence
  Description of Artificial Sequence: Synthetic oligonucleotide
  Target: SOD1; (-) strand; PAM type: YTN; PAM sequence: TTC
aggacatctaagtagctgtg

SEQ ID NO: 12657 - DNA, 20 bp, Artificial Sequence
  Description of Artificial Sequence: Synthetic oligonucleotide
  Target: SOD1; (-) strand; PAM type: YTN; PAM sequence: TTA
accggtaatacattcaggac

SEQ ID NO: 12658 - DNA, 20 bp, Artificial Sequence
  Description of Artificial Sequence: Synthetic oligonucleotide
  Target: SOD1; (-) strand; PAM type: YTN; PAM sequence: TTT
aaccggtaatacattcagga

SEQ ID NO: 12659 - DNA, 20 bp, Artificial Sequence
  Description of Artificial Sequence: Synthetic oligonucleotide
  Target: SOD1; (-) strand; PAM type: YTN; PAM sequence: CTC
catttaaccggtaatacatt

SEQ ID NO: 12660 - DNA, 20 bp, Artificial Sequence
  Description of Artificial Sequence: Synthetic oligonucleotide
  Target: SOD1; (-) strand; PAM type: YTN; PAM sequence: TTG
aaacctccatttaaccggta

SEQ ID NO: 12661 - DNA, 20 bp, Artificial Sequence
  Description of Artificial Sequence: Synthetic oligonucleotide
  Target: SOD1; (-) strand; PAM type: YTN; PAM sequence: TTT
gaaacctccatttaaccggt

SEQ ID NO: 12662 - DNA, 20 bp, Artificial Sequence
  Description of Artificial Sequence: Synthetic oligonucleotide
  Target: SOD1; (-) strand; PAM type: YTN; PAM sequence: CTT
tgaaacctccatttaaccgg

SEQ ID NO: 12663 - DNA, 20 bp, Artificial Sequence
  Description of Artificial Sequence: Synthetic oligonucleotide
  Target: SOD1; (-) strand; PAM type: YTN; PAM sequence: TTC
tttgaaacctccatttaacc

SEQ ID NO: 12664 - DNA, 20 bp, Artificial Sequence
  Description of Artificial Sequence: Synthetic oligonucleotide
  Target: SOD1; (-) strand; PAM type: YTN; PAM sequence: TTA
tcaagagcacagggccaaaa

SEQ ID NO: 12665 - DNA, 20 bp, Artificial Sequence
  Description of Artificial Sequence: Synthetic oligonucleotide
  Target: SOD1; (-) strand; PAM type: YTN; PAM sequence: CTG
ttatcaagagcacagggcca

SEQ ID NO: 12666 - DNA, 20 bp, Artificial Sequence
  Description of Artificial Sequence: Synthetic oligonucleotide
  Target: SOD1; (-) strand; PAM type: YTN; PAM sequence: CTC
tgttatcaagagcacagggc

SEQ ID NO: 12667 - DNA, 20 bp, Artificial Sequence
  Description of Artificial Sequence: Synthetic oligonucleotide
  Target: SOD1; (-) strand; PAM type: YTN; PAM sequence: CTC
aaacactctgttatcaagag

SEQ ID NO: 12668 - DNA, 20 bp, Artificial Sequence
  Description of Artificial Sequence: Synthetic oligonucleotide
  Target: SOD1; (-) strand; PAM type: YTN; PAM sequence: TTG
tccctcaaacactctgttat

SEQ ID NO: 12669 - DNA, 20 bp, Artificial Sequence
  Description of Artificial Sequence: Synthetic oligonucleotide
  Target: SOD1; (-) strand; PAM type: YTN; PAM sequence: CTC
aaatgtgaaagttgtccctc

SEQ ID NO: 12670 - DNA, 20 bp, Artificial Sequence
  Description of Artificial Sequence: Synthetic oligonucleotide
  Target: SOD1; (-) strand; PAM type: YTN; PAM sequence: TTG
gaaaaactcaaatgtgaaag

SEQ ID NO: 12671 - DNA, 20 bp, Artificial Sequence
  Description of Artificial Sequence: Synthetic oligonucleotide
  Target: SOD1; (-) strand; PAM type: YTN; PAM sequence: TTT
ggaaaaactcaaatgtgaaa

SEQ ID NO: 12672 - DNA, 20 bp, Artificial Sequence
  Description of Artificial Sequence: Synthetic oligonucleotide
  Target: SOD1; (-) strand; PAM type: YTN; PAM sequence: TTT
tggaaaaactcaaatgtgaa

SEQ ID NO: 12673 - DNA, 20 bp, Artificial Sequence
  Description of Artificial Sequence: Synthetic oligonucleotide
  Target: SOD1; (-) strand; PAM type: YTN; PAM sequence: TTA
attttggaaaaactcaaatg

SEQ ID NO: 12674 - DNA, 20 bp, Artificial Sequence
  Description of Artificial Sequence: Synthetic oligonucleotide
  Target: SOD1; (-) strand; PAM type: YTN; PAM sequence: TTT
aattttggaaaaactcaaat

SEQ ID NO: 12675 - DNA, 20 bp, Artificial Sequence
  Description of Artificial Sequence: Synthetic oligonucleotide
  Target: SOD1; (-) strand; PAM type: YTN; PAM sequence: CTT
taattttggaaaaactcaaa

SEQ ID NO: 12676 - DNA, 20 bp, Artificial Sequence
  Description of Artificial Sequence: Synthetic oligonucleotide
  Target: SOD1; (-) strand; PAM type: YTN; PAM sequence: CTA
caacctttaattttggaaaa

SEQ ID NO: 12677 - DNA, 20 bp, Artificial Sequence
  Description of Artificial Sequence: Synthetic oligonucleotide
  Target: SOD1; (-) strand; PAM type: YTN; PAM sequence: TTC
tacaacctttaattttggaa

SEQ ID NO: 12678 - DNA, 20 bp, Artificial Sequence
  Description of Artificial Sequence: Synthetic oligonucleotide
  Target: SOD1; (-) strand; PAM type: YTN; PAM sequence: CTT
ctacaacctttaattttgga

SEQ ID NO: 12679 - DNA, 20 bp, Artificial Sequence
  Description of Artificial Sequence: Synthetic oligonucleotide
  Target: SOD1; (-) strand; PAM type: YTN; PAM sequence: CTC
ttctacaacctttaattttg

SEQ ID NO: 12680 - DNA, 20 bp, Artificial Sequence
  Description of Artificial Sequence: Synthetic oligonucleotide
  Target: SOD1; (-) strand; PAM type: YTN; PAM sequence: CTG
tgactcttctacaaccttta

SEQ ID NO: 12681 - DNA, 20 bp, Artificial Sequence
  Description of Artificial Sequence: Synthetic oligonucleotide
  Target: SOD1; (-) strand; PAM type: YTN; PAM sequence: TTG
acaatagatactgtgactct

SEQ ID NO: 12682 - DNA, 20 bp, Artificial Sequence
  Description of Artificial Sequence: Synthetic oligonucleotide
  Target: SOD1; (-) strand; PAM type: YTN; PAM sequence: TTT
gacaatagatactgtgactc

SEQ ID NO: 12683 - DNA, 20 bp, Artificial Sequence
  Description of Artificial Sequence: Synthetic oligonucleotide
  Target: SOD1; (-) strand; PAM type: YTN; PAM sequence: TTT
tgacaatagatactgtgact

SEQ ID NO: 12684 - DNA, 20 bp, Artificial Sequence
  Description of Artificial Sequence: Synthetic oligonucleotide
  Target: SOD1; (-) strand; PAM type: YTN; PAM sequence: TTT
ttgacaatagatactgtgac

SEQ ID NO: 12685 - DNA, 20 bp, Artificial Sequence
  Description of Artificial Sequence: Synthetic oligonucleotide
  Target: SOD1; (-) strand; PAM type: YTN; PAM sequence: CTT
tttgacaatagatactgtga

SEQ ID NO: 12686 - DNA, 20 bp, Artificial Sequence
  Description of Artificial Sequence: Synthetic oligonucleotide
  Target: SOD1; (-) strand; PAM type: YTN; PAM sequence: TTC
tttttgacaatagatactgt

SEQ ID NO: 12687 - DNA, 20 bp, Artificial Sequence
  Description of Artificial Sequence: Synthetic oligonucleotide
  Target: SOD1; (-) strand; PAM type: YTN; PAM sequence: TTT
ctttttgacaatagatactg

SEQ ID NO: 12688 - DNA, 20 bp, Artificial Sequence
  Description of Artificial Sequence: Synthetic oligonucleotide
  Target: SOD1; (-) strand; PAM type: YTN; PAM sequence: TTT
tctttttgacaatagatact

SEQ ID NO: 12689 - DNA, 20 bp, Artificial Sequence
  Description of Artificial Sequence: Synthetic oligonucleotide
  Target: SOD1; (-) strand; PAM type: YTN; PAM sequence: CTT
ttctttttgacaatagatac

SEQ ID NO: 12690 - DNA, 20 bp, Artificial Sequence
  Description of Artificial Sequence: Synthetic oligonucleotide
  Target: SOD1; (-) strand; PAM type: YTN; PAM sequence: TTC
ttttctttttgacaatagat

SEQ ID NO: 12691 - DNA, 20 bp, Artificial Sequence
  Description of Artificial Sequence: Synthetic oligonucleotide
  Target: SOD1; (-) strand; PAM type: YTN; PAM sequence: TTA
aattcttttctttttgacaa

SEQ ID NO: 12692 - DNA, 20 bp, Artificial Sequence
  Description of Artificial Sequence: Synthetic oligonucleotide
  Target: SOD1; (-) strand; PAM type: YTN; PAM sequence: TTT
aaattcttttctttttgaca

SEQ ID NO: 12693 - DNA, 20 bp, Artificial Sequence
  Description of Artificial Sequence: Synthetic oligonucleotide
  Target: SOD1; (-) strand; PAM type: YTN; PAM sequence: TTT
taaattcttttctttttgac

SEQ ID NO: 12694 - DNA, 20 bp, Artificial Sequence
  Description of Artificial Sequence: Synthetic oligonucleotide
  Target: SOD1; (-) strand; PAM type: YTN; PAM sequence: TTT
ttaaattcttttctttttga

SEQ ID NO: 12695 - DNA, 20 bp, Artificial Sequence
  Description of Artificial Sequence: Synthetic oligonucleotide
  Target: SOD1; (-) strand; PAM type: YTN; PAM sequence: CTT
tttaaattcttttctttttg

SEQ ID NO: 12696 - DNA, 20 bp, Artificial Sequence
  Description of Artificial Sequence: Synthetic oligonucleotide
  Target: SOD1; (-) strand; PAM type: YTN; PAM sequence: CTG
cctttttaaattcttttctt

SEQ ID NO: 12697 - DNA, 20 bp, Artificial Sequence
  Description of Artificial Sequence: Synthetic oligonucleotide
  Target: SOD1; (-) strand; PAM type: YTN; PAM sequence: TTG
ctgcctttttaaattctttt

SEQ ID NO: 12698 - DNA, 20 bp, Artificial Sequence
  Description of Artificial Sequence: Synthetic oligonucleotide
  Target: SOD1; (-) strand; PAM type: YTN; PAM sequence: CTG
gcaattgctgcctttttaaa

SEQ ID NO: 12699 - DNA, 20 bp, Artificial Sequence
  Description of Artificial Sequence: Synthetic oligonucleotide
  Target: SOD1; (-) strand; PAM type: YTN; PAM sequence: CTC
aaatgaagtatcctggcaat

SEQ ID NO: 12700 - DNA, 20 bp, Artificial Sequence
  Description of Artificial Sequence: Synthetic oligonucleotide
  Target: SOD1; (-) strand; PAM type: YTN; PAM sequence: TTG
ctcaaatgaagtatcctggc

SEQ ID NO: 12701 - DNA, 20 bp, Artificial Sequence
  Description of Artificial Sequence: Synthetic oligonucleotide
  Target: SOD1; (-) strand; PAM type: YTN; PAM sequence: CTG
gaaaatatcattgctcaaat

SEQ ID NO: 12702 - DNA, 20 bp, Artificial Sequence
  Description of Artificial Sequence: Synthetic oligonucleotide
  Target: SOD1; (-) strand; PAM type: YTN; PAM sequence: TTC
cactggaaaatatcattgct

SEQ ID NO: 12703 - DNA, 20 bp, Artificial Sequence
  Description of Artificial Sequence: Synthetic oligonucleotide
  Target: SOD1; (-) strand; PAM type: YTN; PAM sequence: TTT
ccactggaaaatatcattgc

SEQ ID NO: 12704 - DNA, 20 bp, Artificial Sequence
  Description of Artificial Sequence: Synthetic oligonucleotide
  Target: SOD1; (-) strand; PAM type: YTN; PAM sequence: CTT
tccactggaaaatatcattg

SEQ ID NO: 12705 - DNA, 20 bp, Artificial Sequence
  Description of Artificial Sequence: Synthetic oligonucleotide
  Target: SOD1; (-) strand; PAM type: YTN; PAM sequence: TTA
agatgtgactttccactgga

SEQ ID NO: 12706 - DNA, 20 bp, Artificial Sequence
  Description of Artificial Sequence: Synthetic oligonucleotide
  Target: SOD1; (-) strand; PAM type: YTN; PAM sequence: CTT
aagatgtgactttccactgg

SEQ ID NO: 12707 - DNA, 20 bp, Artificial Sequence
  Description of Artificial Sequence: Synthetic oligonucleotide
  Target: SOD1; (-) strand; PAM type: YTN; PAM sequence: TTA
acccttaagatgtgactttc

SEQ ID NO: 12708 - DNA, 20 bp, Artificial Sequence
  Description of Artificial Sequence: Synthetic oligonucleotide
  Target: SOD1; (-) strand; PAM type: YTN; PAM sequence: TTA
aggggcattaacccttaaga

SEQ ID NO: 12709 - DNA, 20 bp, Artificial Sequence
  Description of Artificial Sequence: Synthetic oligonucleotide
  Target: SOD1; (-) strand; PAM type: YTN; PAM sequence: TTC
aaatacggccaacagttaag

SEQ ID NO: 12710 - DNA, 20 bp, Artificial Sequence
  Description of Artificial Sequence: Synthetic oligonucleotide
  Target: SOD1; (-) strand; PAM type: YTN; PAM sequence: TTT
caaatacggccaacagttaa

SEQ ID NO: 12711 - DNA, 20 bp, Artificial Sequence
  Description of Artificial Sequence: Synthetic oligonucleotide
  Target: SOD1; (-) strand; PAM type: YTN; PAM sequence: TTT
tcaaatacggccaacagtta

SEQ ID NO: 12712 - DNA, 20 bp, Artificial Sequence
  Description of Artificial Sequence: Synthetic oligonucleotide
  Target: SOD1; (-) strand; PAM type: YTN; PAM sequence: TTG
ttttcaaatacggccaacag

SEQ ID NO: 12713 - DNA, 20 bp, Artificial Sequence
  Description of Artificial Sequence: Synthetic oligonucleotide
  Target: SOD1; (-) strand; PAM type: YTN; PAM sequence: TTT
gttttcaaatacggccaaca

SEQ ID NO: 12714 - DNA, 20 bp, Artificial Sequence
  Description of Artificial Sequence: Synthetic oligonucleotide
  Target: SOD1; (-) strand; PAM type: YTN; PAM sequence: TTG
gtttgttttcaaatacggcc

SEQ ID NO: 12715 - DNA, 20 bp, Artificial Sequence
  Description of Artificial Sequence: Synthetic oligonucleotide
  Target: SOD1; (-) strand; PAM type: YTN; PAM sequence: CTT
ggtttgttttcaaatacggc

SEQ ID NO: 12716 - DNA, 20 bp, Artificial Sequence
  Description of Artificial Sequence: Synthetic oligonucleotide
  Target: SOD1; (-) strand; PAM type: YTN; PAM sequence: TTA
gcttggtttgttttcaaata

SEQ ID NO: 12717 - DNA, 20 bp, Artificial Sequence
  Description of Artificial Sequence: Synthetic oligonucleotide
  Target: SOD1; (-) strand; PAM type: YTN; PAM sequence: TTT
agcttggtttgttttcaaat

SEQ ID NO: 12718 - DNA, 20 bp, Artificial Sequence
  Description of Artificial Sequence: Synthetic oligonucleotide
  Target: SOD1; (-) strand; PAM type: YTN; PAM sequence: TTT
tagcttggtttgttttcaaa

SEQ ID NO: 12719 - DNA, 20 bp, Artificial Sequence
  Description of Artificial Sequence: Synthetic oligonucleotide
  Target: SOD1; (-) strand; PAM type: YTN; PAM sequence: TTT
ttagcttggtttgttttcaa

SEQ ID NO: 12720 - DNA, 20 bp, Artificial Sequence
  Description of Artificial Sequence: Synthetic oligonucleotide
  Target: SOD1; (-) strand; PAM type: YTN; PAM sequence: TTG
tttttagcttggtttgtttt

SEQ ID NO: 12721 - DNA, 20 bp, Artificial Sequence
  Description of Artificial Sequence: Synthetic oligonucleotide
  Target: SOD1; (-) strand; PAM type: YTN; PAM sequence: CTT
gtttttagcttggtttgttt

SEQ ID NO: 12722 - DNA, 20 bp, Artificial Sequence
  Description of Artificial Sequence: Synthetic oligonucleotide
  Target: SOD1; (-) strand; PAM type: YTN; PAM sequence: CTC
ttgtttttagcttggtttgt

SEQ ID NO: 12723 - DNA, 20 bp, Artificial Sequence
  Description of Artificial Sequence: Synthetic oligonucleotide
  Target: SOD1; (-) strand; PAM type: YTN; PAM sequence: CTA
aaataaacacaacatccaca

SEQ ID NO: 12724 - DNA, 20 bp, Artificial Sequence
  Description of Artificial Sequence: Synthetic oligonucleotide
  Target: SOD1; (-) strand; PAM type: YTN; PAM sequence: CTC
aggactaaaataaacacaac

SEQ ID NO: 12725 - DNA, 20 bp, Artificial Sequence
  Description of Artificial Sequence: Synthetic oligonucleotide
  Target: SOD1; (-) strand; PAM type: YTN; PAM sequence: CTA
gatctcaggactaaaataaa

SEQ ID NO: 12726 - DNA, 20 bp, Artificial Sequence
  Description of Artificial Sequence: Synthetic oligonucleotide
  Target: SOD1; (-) strand; PAM type: YTN; PAM sequence: TTA
caactagatctcaggactaa

SEQ ID NO: 12727 - DNA, 20 bp, Artificial Sequence
  Description of Artificial Sequence: Synthetic oligonucleotide
  Target: SOD1; (-) strand; PAM type: YTN; PAM sequence: CTA
catacagaaatcaaggaagt

SEQ ID NO: 12728 - DNA, 20 bp, Artificial Sequence
  Description of Artificial Sequence: Synthetic oligonucleotide
  Target: SOD1; (-) strand; PAM type: YTN; PAM sequence: CTC
cgtggctacatacagaaatc

SEQ ID NO: 12729 - DNA, 20 bp, Artificial Sequence
  Description of Artificial Sequence: Synthetic oligonucleotide
  Target: SOD1; (-) strand; PAM type: YTN; PAM sequence: TTC
aggtaatggtgacaggtaat

SEQ ID NO: 12730 - DNA, 20 bp, Artificial Sequence
  Description of Artificial Sequence: Synthetic oligonucleotide
  Target: SOD1; (-) strand; PAM type: YTN; PAM sequence: CTA
ccaaaatgaaagcaagcagt

SEQ ID NO: 12731 - DNA, 20 bp, Artificial Sequence
  Description of Artificial Sequence: Synthetic oligonucleotide
  Target: SOD1; (-) strand; PAM type: YTN; PAM sequence: CTC
taccaaaatgaaagcaagca

SEQ ID NO: 12732 - DNA, 20 bp, Artificial Sequence
  Description of Artificial Sequence: Synthetic oligonucleotide
  Target: SOD1; (-) strand; PAM type: YTN; PAM sequence: TTC
cactctaccaaaatgaaagc

SEQ ID NO: 12733 - DNA, 20 bp, Artificial Sequence
  Description of Artificial Sequence: Synthetic oligonucleotide
  Target: SOD1; (-) strand; PAM type: YTN; PAM sequence: TTT
ccactctaccaaaatgaaag

SEQ ID NO: 12734 - DNA, 20 bp, Artificial Sequence
  Description of Artificial Sequence: Synthetic oligonucleotide
  Target: SOD1; (-) strand; PAM type: YTN; PAM sequence: CTT
tccactctaccaaaatgaaa

SEQ ID NO: 12735 - DNA, 20 bp, Artificial Sequence
  Description of Artificial Sequence: Synthetic oligonucleotide
  Target: SOD1; (-) strand; PAM type: YTN; PAM sequence: CTA
ggtaacctttccactctacc

SEQ ID NO: 12736 - DNA, 20 bp, Artificial Sequence
  Description of Artificial Sequence: Synthetic oligonucleotide
  Target: SOD1; (-) strand; PAM type: YTN; PAM sequence: CTG
aaacctaggtaacctttcca

SEQ ID NO: 12737 - DNA, 20 bp, Artificial Sequence
  Description of Artificial Sequence: Synthetic oligonucleotide
  Target: SOD1; (-) strand; PAM type: YTN; PAM sequence: TTC
aagcactgaaacctaggtaa

SEQ ID NO: 12738 - DNA, 20 bp, Artificial Sequence
  Description of Artificial Sequence: Synthetic oligonucleotide
  Target: SOD1; (-) strand; PAM type: YTN; PAM sequence: TTT
caagcactgaaacctaggta

SEQ ID NO: 12739 - DNA, 20 bp, Artificial Sequence
  Description of Artificial Sequence: Synthetic oligonucleotide
  Target: SOD1; (-) strand; PAM type: YTN; PAM sequence: TTT
tcaagcactgaaacctaggt

SEQ ID NO: 12740 - DNA, 20 bp, Artificial Sequence
  Description of Artificial Sequence: Synthetic oligonucleotide
  Target: SOD1; (-) strand; PAM type: YTN; PAM sequence: CTT
ttcaagcactgaaacctagg

SEQ ID NO: 12741 - DNA, 20 bp, Artificial Sequence
  Description of Artificial Sequence: Synthetic oligonucleotide
  Target: SOD1; (-) strand; PAM type: YTN; PAM sequence: CTG
aaatcttttcaagcactgaa

SEQ ID NO: 12742 - DNA, 20 bp, Artificial Sequence
  Description of Artificial Sequence: Synthetic oligonucleotide
  Target: SOD1; (-) strand; PAM type: YTN; PAM sequence: TTC
tgaaatcttttcaagcactg

SEQ ID NO: 12743 - DNA, 20 bp, Artificial Sequence
  Description of Artificial Sequence: Synthetic oligonucleotide
  Target: SOD1; (-) strand; PAM type: YTN; PAM sequence: TTT
ctgaaatcttttcaagcact

SEQ ID NO: 12744 - DNA, 20 bp, Artificial Sequence
  Description of Artificial Sequence: Synthetic oligonucleotide
  Target: SOD1; (-) strand; PAM type: YTN; PAM sequence: CTT
tctgaaatcttttcaagcac

SEQ ID NO: 12745 - DNA, 20 bp, Artificial Sequence
  Description of Artificial Sequence: Synthetic oligonucleotide
  Target: SOD1; (-) strand; PAM type: YTN; PAM sequence: CTG
ctttctgaaatcttttcaag

SEQ ID NO: 12746 - DNA, 20 bp, Artificial Sequence
  Description of Artificial Sequence: Synthetic oligonucleotide
  Target: SOD1; (-) strand; PAM type: YTN; PAM sequence: CTA
ctgctttctgaaatcttttc

SEQ ID NO: 12747 - DNA, 20 bp, Artificial Sequence
  Description of Artificial Sequence: Synthetic oligonucleotide
  Target: SOD1; (-) strand; PAM type: YTN; PAM sequence: CTA
accagacgtactactgcttt

SEQ ID NO: 12748 - DNA, 20 bp, Artificial Sequence
  Description of Artificial Sequence: Synthetic oligonucleotide
  Target: SOD1; (-) strand; PAM type: YTN; PAM sequence: CTA
gtctaaccagacgtactact

SEQ ID NO: 12749 - DNA, 20 bp, Artificial Sequence
  Description of Artificial Sequence: Synthetic oligonucleotide
  Target: SOD1; (-) strand; PAM type: YTN; PAM sequence: TTC
tagtctaaccagacgtacta

SEQ ID NO: 12750 - DNA, 20 bp, Artificial Sequence
  Description of Artificial Sequence: Synthetic oligonucleotide
  Target: SOD1; (-) strand; PAM type: YTN; PAM sequence: CTG
attctagtctaaccagacgt

SEQ ID NO: 12751 - DNA, 20 bp, Artificial Sequence
  Description of Artificial Sequence: Synthetic oligonucleotide
  Target: SOD1; (-) strand; PAM type: YTN; PAM sequence: CTG
cccccaggagaggactgatt

SEQ ID NO: 12752 - DNA, 20 bp, Artificial Sequence
  Description of Artificial Sequence: Synthetic oligonucleotide
  Target: SOD1; (-) strand; PAM type: YTN; PAM sequence: TTC
cactgcccccaggagaggac

SEQ ID NO: 12753 - DNA, 20 bp, Artificial Sequence
  Description of Artificial Sequence: Synthetic oligonucleotide
  Target: SOD1; (-) strand; PAM type: YTN; PAM sequence: TTA
tattccactgcccccaggag

SEQ ID NO: 12754 - DNA, 20 bp, Artificial Sequence
  Description of Artificial Sequence: Synthetic oligonucleotide
  Target: SOD1; (-) strand; PAM type: YTN; PAM sequence: TTA
gcagtcagaaaatattatat

SEQ ID NO: 12755 - DNA, 20 bp, Artificial Sequence
  Description of Artificial Sequence: Synthetic oligonucleotide
  Target: SOD1; (-) strand; PAM type: YTN; PAM sequence: TTA
attagcagtcagaaaatatt

SEQ ID NO: 12756 - DNA, 20 bp, Artificial Sequence
  Description of Artificial Sequence: Synthetic oligonucleotide
  Target: SOD1; (-) strand; PAM type: YTN; PAM sequence: TTT
aattagcagtcagaaaatat

SEQ ID NO: 12757 - DNA, 20 bp, Artificial Sequence
  Description of Artificial Sequence: Synthetic oligonucleotide
  Target: SOD1; (-) strand; PAM type: YTN; PAM sequence: TTT
taattagcagtcagaaaata

SEQ ID NO: 12758 - DNA, 20 bp, Artificial Sequence
  Description of Artificial Sequence: Synthetic oligonucleotide
  Target: SOD1; (-) strand; PAM type: YTN; PAM sequence: TTT
ttaattagcagtcagaaaat

SEQ ID NO: 12759 - DNA, 20 bp, Artificial Sequence
  Description of Artificial Sequence: Synthetic oligonucleotide
  Target: SOD1; (-) strand; PAM type: YTN; PAM sequence: CTA
tcacaggtatttttaattag

SEQ ID NO: 12760 - DNA, 20 bp, Artificial Sequence
  Description of Artificial Sequence: Synthetic oligonucleotide
  Target: SOD1; (-) strand; PAM type: YTN; PAM sequence: TTA
caggcgtaagccaccacgcc

SEQ ID NO: 12761 - DNA, 20 bp, Artificial Sequence
  Description of Artificial Sequence: Synthetic oligonucleotide
  Target: SOD1; (-) strand; PAM type: YTN; PAM sequence: CTG
ggattacaggcgtaagccac

SEQ ID NO: 12762 - DNA, 20 bp, Artificial Sequence
  Description of Artificial Sequence: Synthetic oligonucleotide
  Target: SOD1; (-) strand; PAM type: YTN; PAM sequence: CTC
ccaaagtgctgggattacag

SEQ ID NO: 12763 - DNA, 20 bp, Artificial Sequence
  Description of Artificial Sequence: Synthetic oligonucleotide
  Target: SOD1; (-) strand; PAM type: YTN; PAM sequence: CTC
ggcctcccaaagtgctggga

SEQ ID NO: 12764 - DNA, 20 bp, Artificial Sequence
  Description of Artificial Sequence: Synthetic oligonucleotide
  Target: SOD1; (-) strand; PAM type: YTN; PAM sequence: CTC
gtgatccacccgtctcggcc

SEQ ID NO: 12765 - DNA, 20 bp, Artificial Sequence
  Description of Artificial Sequence: Synthetic oligonucleotide
  Target: SOD1; (-) strand; PAM type: YTN; PAM sequence: CTG
acctcgtgatccacccgtct

SEQ ID NO: 12766 - DNA, 20 bp, Artificial Sequence
  Description of Artificial Sequence: Synthetic oligonucleotide
  Target: SOD1; (-) strand; PAM type: YTN; PAM sequence: CTG
ctgacctcgtgatccacccg

SEQ ID NO: 12767 - DNA, 20 bp, Artificial Sequence
  Description of Artificial Sequence: Synthetic oligonucleotide
  Target: SOD1; (-) strand; PAM type: YTN; PAM sequence: CTC
catctgctgacctcgtgatc

SEQ ID NO: 12768 - DNA, 20 bp, Artificial Sequence
  Description of Artificial Sequence: Synthetic oligonucleotide
  Target: SOD1; (-) strand; PAM type: YTN; PAM sequence: TTA
gccaggatggtctccatctg

SEQ ID NO: 12769 - DNA, 20 bp, Artificial Sequence
  Description of Artificial Sequence: Synthetic oligonucleotide
  Target: SOD1; (-) strand; PAM type: YTN; PAM sequence: TTC
accgtgttagccaggatggt

SEQ ID NO: 12770 - DNA, 20 bp, Artificial Sequence
  Description of Artificial Sequence: Synthetic oligonucleotide
  Target: SOD1; (-) strand; PAM type: YTN; PAM sequence: TTT
caccgtgttagccaggatgg

SEQ ID NO: 12771 - DNA, 20 bp, Artificial Sequence
  Description of Artificial Sequence: Synthetic oligonucleotide
  Target: SOD1; (-) strand; PAM type: YTN; PAM sequence: TTA
gtagagacggggtttcaccg

SEQ ID NO: 12772 - DNA, 20 bp, Artificial Sequence
  Description of Artificial Sequence: Synthetic oligonucleotide
  Target: SOD1; (-) strand; PAM type: YTN; PAM sequence: TTT
agtagagacggggtttcacc

SEQ ID NO: 12773 - DNA, 20 bp, Artificial Sequence
  Description of Artificial Sequence: Synthetic oligonucleotide
  Target: SOD1; (-) strand; PAM type: YTN; PAM sequence: TTT
tagtagagacggggtttcac

SEQ ID NO: 12774 - DNA, 20 bp, Artificial Sequence
  Description of Artificial Sequence: Synthetic oligonucleotide
  Target: SOD1; (-) strand; PAM type: YTN; PAM sequence: TTT
ttagtagagacggggtttca

SEQ ID NO: 12775 - DNA, 20 bp, Artificial Sequence
  Description of Artificial Sequence: Synthetic oligonucleotide
  Target: SOD1; (-) strand; PAM type: YTN; PAM sequence: TTG
catttttagtagagacgggg

SEQ ID NO: 12776 - DNA, 20 bp, Artificial Sequence
  Description of Artificial Sequence: Synthetic oligonucleotide
  Target: SOD1; (-) strand; PAM type: YTN; PAM sequence: TTT
gcatttttagtagagacggg

SEQ ID NO: 12777 - DNA, 20 bp, Artificial Sequence
  Description of Artificial Sequence: Synthetic oligonucleotide
  Target: SOD1; (-) strand; PAM type: YTN; PAM sequence: TTT
tgcatttttagtagagacgg

SEQ ID NO: 12778 - DNA, 20 bp, Artificial Sequence
  Description of Artificial Sequence: Synthetic oligonucleotide
  Target: SOD1; (-) strand; PAM type: YTN; PAM sequence: TTT
ttgcatttttagtagagacg

SEQ ID NO: 12779 - DNA, 20 bp, Artificial Sequence
  Description of Artificial Sequence: Synthetic oligonucleotide
  Target: SOD1; (-) strand; PAM type: YTN; PAM sequence: TTT
tttgcatttttagtagagac

SEQ ID NO: 12780 - DNA, 20 bp, Artificial Sequence
  Description of Artificial Sequence: Synthetic oligonucleotide
  Target: SOD1; (-) strand; PAM type: YTN; PAM sequence: TTT
ttttgcatttttagtagaga

SEQ ID NO: 12781 - DNA, 20 bp, Artificial Sequence
  Description of Artificial Sequence: Synthetic oligonucleotide
  Target: SOD1; (-) strand; PAM type: YTN; PAM sequence: CTA
atttttttgcatttttagta

SEQ ID NO: 12782 - DNA, 20 bp, Artificial Sequence
  Description of Artificial Sequence: Synthetic oligonucleotide
  Target: SOD1; (-) strand; PAM type: YTN; PAM sequence: CTA
caggcgcccaccaccacacc

SEQ ID NO: 12783 - DNA, 20 bp, Artificial Sequence
  Description of Artificial Sequence: Synthetic oligonucleotide
  Target: SOD1; (-) strand; PAM type: YTN; PAM sequence: CTG
ggactacaggcgcccaccac

SEQ ID NO: 12784 - DNA, 20 bp, Artificial Sequence
  Description of Artificial Sequence: Synthetic oligonucleotide
  Target: SOD1; (-) strand; PAM type: YTN; PAM sequence: CTG
agtagctgggactacaggcg

SEQ ID NO: 12785 - DNA, 20 bp, Artificial Sequence
  Description of Artificial Sequence: Synthetic oligonucleotide
  Target: SOD1; (-) strand; PAM type: YTN; PAM sequence: CTC
ctgagtagctgggactacag

SEQ ID NO: 12786 - DNA, 20 bp, Artificial Sequence
  Description of Artificial Sequence: Synthetic oligonucleotide
  Target: SOD1; (-) strand; PAM type: YTN; PAM sequence: CTC
agcctcctgagtagctggga

SEQ ID NO: 12787 - DNA, 20 bp, Artificial Sequence
  Description of Artificial Sequence: Synthetic oligonucleotide
  Target: SOD1; (-) strand; PAM type: YTN; PAM sequence: CTG
cctcagcctcctgagtagct

SEQ ID NO: 12788 - DNA, 20 bp, Artificial Sequence
  Description of Artificial Sequence: Synthetic oligonucleotide
  Target: SOD1; (-) strand; PAM type: YTN; PAM sequence: CTC
ctgcctcagcctcctgagta

SEQ ID NO: 12789 - DNA, 20 bp, Artificial Sequence
  Description of Artificial Sequence: Synthetic oligonucleotide
  Target: SOD1; (-) strand; PAM type: YTN; PAM sequence: TTC
tcctgcctcagcctcctgag

SEQ ID NO: 12790 - DNA, 20 bp, Artificial Sequence
  Description of Artificial Sequence: Synthetic oligonucleotide
  Target: SOD1; (-) strand; PAM type: YTN; PAM sequence: TTC
atgccattctcctgcctcag

SEQ ID NO: 12791 - DNA, 20 bp, Artificial Sequence
  Description of Artificial Sequence: Synthetic oligonucleotide
  Target: SOD1; (-) strand; PAM type: YTN; PAM sequence: CTC
ccaggttcatgccattctcc

SEQ ID NO: 12792 - DNA, 20 bp, Artificial Sequence
  Description of Artificial Sequence: Synthetic oligonucleotide
  Target: SOD1; (-) strand; PAM type: YTN; PAM sequence: CTC
cgcctcccaggttcatgcca

SEQ ID NO: 12793 - DNA, 20 bp, Artificial Sequence
  Description of Artificial Sequence: Synthetic oligonucleotide
  Target: SOD1; (-) strand; PAM type: YTN; PAM sequence: CTG
caagctccgcctcccaggtt

SEQ ID NO: 12794 - DNA, 20 bp, Artificial Sequence
  Description of Artificial Sequence: Synthetic oligonucleotide
  Target: SOD1; (-) strand; PAM type: YTN; PAM sequence: CTC
actgcaagctccgcctccca

SEQ ID NO: 12795 - DNA, 20 bp, Artificial Sequence
  Description of Artificial Sequence: Synthetic oligonucleotide
  Target: SOD1; (-) strand; PAM type: YTN; PAM sequence: CTC
ggctcactgcaagctccgcc

SEQ ID NO: 12796 - DNA, 20 bp, Artificial Sequence
  Description of Artificial Sequence: Synthetic oligonucleotide
  Target: SOD1; (-) strand; PAM type: YTN; PAM sequence: CTG
gagtgcagtgacatgatctc

SEQ ID NO: 12797 - DNA, 20 bp, Artificial Sequence
  Description of Artificial Sequence: Synthetic oligonucleotide
  Target: SOD1; (-) strand; PAM type: YTN; PAM sequence: CTG
tcgcccaggctggagtgcag

SEQ ID NO: 12798 - DNA, 20 bp, Artificial Sequence
  Description of Artificial Sequence: Synthetic oligonucleotide
  Target: SOD1; (-) strand; PAM type: YTN; PAM sequence: CTC
tgtcgcccaggctggagtgc

SEQ ID NO: 12799 - DNA, 20 bp, Artificial Sequence
  Description of Artificial Sequence: Synthetic oligonucleotide
  Target: SOD1; (-) strand; PAM type: YTN; PAM sequence: CTC
gctctgtcgcccaggctgga

SEQ ID NO: 12800 - DNA, 20 bp, Artificial Sequence
  Description of Artificial Sequence: Synthetic oligonucleotide
  Target: SOD1; (-) strand; PAM type: YTN; PAM sequence: TTG
agacgagtctcgctctgtcg

SEQ ID NO: 12801 - DNA, 20 bp, Artificial Sequence
  Description of Artificial Sequence: Synthetic oligonucleotide
  Target: SOD1; (-) strand; PAM type: YTN; PAM sequence: TTT
gagacgagtctcgctctgtc

SEQ ID NO: 12802 - DNA, 20 bp, Artificial Sequence
  Description of Artificial Sequence: Synthetic oligonucleotide
  Target: SOD1; (-) strand; PAM type: YTN; PAM sequence: TTT
tgagacgagtctcgctctgt

SEQ ID NO: 12803 - DNA, 20 bp, Artificial Sequence
  Description of Artificial Sequence: Synthetic oligonucleotide
  Target: SOD1; (-) strand; PAM type: YTN; PAM sequence: TTT
ttgagacgagtctcgctctg

SEQ ID NO: 12804 - DNA, 20 bp, Artificial Sequence
  Description of Artificial Sequence: Synthetic oligonucleotide
  Target: SOD1; (-) strand; PAM type: YTN; PAM sequence: TTT
tttgagacgagtctcgctct

SEQ ID NO: 12805 - DNA, 20 bp, Artificial Sequence
  Description of Artificial Sequence: Synthetic oligonucleotide
  Target: SOD1; (-) strand; PAM type: YTN; PAM sequence: TTT
ttttgagacgagtctcgctc

SEQ ID NO: 12806 - DNA, 20 bp, Artificial Sequence
  Description of Artificial Sequence: Synthetic oligonucleotide
  Target: SOD1; (-) strand; PAM type: YTN; PAM sequence: TTT
tttttgagacgagtctcgct

SEQ ID NO: 12807 - DNA, 20 bp, Artificial Sequence
  Description of Artificial Sequence: Synthetic oligonucleotide
  Target: SOD1; (-) strand; PAM type: YTN; PAM sequence: TTT
ttttttgagacgagtctcgc

SEQ ID NO: 12808 - DNA, 20 bp, Artificial Sequence
  Description of Artificial Sequence: Synthetic oligonucleotide
  Target: SOD1; (-) strand; PAM type: YTN; PAM sequence: TTT
tttttttgagacgagtctcg

SEQ ID NO: 12809 - DNA, 20 bp, Artificial Sequence
  Description of Artificial Sequence: Synthetic oligonucleotide
  Target: SOD1; (-) strand; PAM type: YTN; PAM sequence: TTT
ttttttttgagacgagtctc

SEQ ID NO: 12810 - DNA, 20 bp, Artificial Sequence
  Description of Artificial Sequence: Synthetic oligonucleotide
  Target: SOD1; (-) strand; PAM type: YTN; PAM sequence: CTT
tttttttttgagacgagtct

SEQ ID NO: 12811 - DNA, 20 bp, Artificial Sequence
  Description of Artificial Sequence: Synthetic oligonucleotide
  Target: SOD1; (-) strand; PAM type: YTN; PAM sequence: TTC
tttttttttttgagacgagt

SEQ ID NO: 12812 - DNA, 20 bp, Artificial Sequence
  Description of Artificial Sequence: Synthetic oligonucleotide
  Target: SOD1; (-) strand; PAM type: YTN; PAM sequence: TTT
ctttttttttttgagacgag

SEQ ID NO: 12813 - DNA, 20 bp, Artificial Sequence
  Description of Artificial Sequence: Synthetic oligonucleotide
  Target: SOD1; (-) strand; PAM type: YTN; PAM sequence: TTT
tctttttttttttgagacga

SEQ ID NO: 12814 - DNA, 20 bp, Artificial Sequence
  Description of Artificial Sequence: Synthetic oligonucleotide
  Target: SOD1; (-) strand; PAM type: YTN; PAM sequence: TTT
ttctttttttttttgagacg

SEQ ID NO: 12815 - DNA, 20 bp, Artificial Sequence
  Description of Artificial Sequence: Synthetic oligonucleotide
  Target: SOD1; (-) strand; PAM type: YTN; PAM sequence: TTT
tttctttttttttttgagac

SEQ ID NO: 12816 - DNA, 20 bp, Artificial Sequence
  Description of Artificial Sequence: Synthetic oligonucleotide
  Target: SOD1; (-) strand; PAM type: YTN; PAM sequence: TTT
ttttctttttttttttgaga

SEQ ID NO: 12817 - DNA, 20 bp, Artificial Sequence
  Description of Artificial Sequence: Synthetic oligonucleotide
  Target: SOD1; (-) strand; PAM type: YTN; PAM sequence: TTA
agtgtccatcataagttttt

SEQ ID NO: 12818 - DNA, 20 bp, Artificial Sequence
  Description of Artificial Sequence: Synthetic oligonucleotide
  Target: SOD1; (-) strand; PAM type: YTN; PAM sequence: TTT
aagtgtccatcataagtttt

SEQ ID NO: 12819 - DNA, 20 bp, Artificial Sequence
  Description of Artificial Sequence: Synthetic oligonucleotide
  Target: SOD1; (-) strand; PAM type: YTN; PAM sequence: TTT
taagtgtccatcataagttt

SEQ ID NO: 12820 - DNA, 20 bp, Artificial Sequence
  Description of Artificial Sequence: Synthetic oligonucleotide
  Target: SOD1; (-) strand; PAM type: YTN; PAM sequence: TTT
ttaagtgtccatcataagtt

SEQ ID NO: 12821 - DNA, 20 bp, Artificial Sequence
  Description of Artificial Sequence: Synthetic oligonucleotide
  Target: SOD1; (-) strand; PAM type: YTN; PAM sequence: CTC
agtgagtgtttttaagtgtc

SEQ ID NO: 12822 - DNA, 20 bp, Artificial Sequence
  Description of Artificial Sequence: Synthetic oligonucleotide
  Target: SOD1; (-) strand; PAM type: YTN; PAM sequence: CTC
cccactcagtgagtgttttt

SEQ ID NO: 12823 - DNA, 20 bp, Artificial Sequence
  Description of Artificial Sequence: Synthetic oligonucleotide
  Target: SOD1; (-) strand; PAM type: YTN; PAM sequence: CTC
cactccccactcagtgagtg

SEQ ID NO: 12824 - DNA, 20 bp, Artificial Sequence
  Description of Artificial Sequence: Synthetic oligonucleotide
  Target: SOD1; (-) strand; PAM type: YTN; PAM sequence: CTC
tccactccccactcagtgag

SEQ ID NO: 12825 - DNA, 20 bp, Artificial Sequence
  Description of Artificial Sequence: Synthetic oligonucleotide
  Target: SOD1; (-) strand; PAM type: YTN; PAM sequence: CTG
ctctccactccccactcagt

SEQ ID NO: 12826 - DNA, 20 bp, Artificial Sequence
  Description of Artificial Sequence: Synthetic oligonucleotide
  Target: SOD1; (-) strand; PAM type: YTN; PAM sequence: CTG
ggacccctgctctccactcc

SEQ ID NO: 12827 - DNA, 20 bp, Artificial Sequence
  Description of Artificial Sequence: Synthetic oligonucleotide
  Target: SOD1; (-) strand; PAM type: YTN; PAM sequence: CTA
ccctgggacccctgctctcc

SEQ ID NO: 12828 - DNA, 20 bp, Artificial Sequence
  Description of Artificial Sequence: Synthetic oligonucleotide
  Target: SOD1; (-) strand; PAM type: YTN; PAM sequence: CTG
gaaatgtccaacaggctacc

SEQ ID NO: 12829 - DNA, 20 bp, Artificial Sequence
  Description of Artificial Sequence: Synthetic oligonucleotide
  Target: SOD1; (-) strand; PAM type: YTN; PAM sequence: TTA
aaaaaaaaaaaagaaaaagt

SEQ ID NO: 12830 - DNA, 20 bp, Artificial Sequence
  Description of Artificial Sequence: Synthetic oligonucleotide
  Target: SOD1; (-) strand; PAM type: YTN; PAM sequence: TTT
aaaaaaaaaaaaagaaaaag

SEQ ID NO: 12831 - DNA, 20 bp, Artificial Sequence
  Description of Artificial Sequence: Synthetic oligonucleotide
  Target: SOD1; (-) strand; PAM type: YTN; PAM sequence: CTT
taaaaaaaaaaaaagaaaaa

SEQ ID NO: 12832 - DNA, 20 bp, Artificial Sequence
  Description of Artificial Sequence: Synthetic oligonucleotide
  Target: SOD1; (-) strand; PAM type: YTN; PAM sequence: TTG
actttaaaaaaaaaaaaaga

SEQ ID NO: 12833 - DNA, 20 bp, Artificial Sequence
  Description of Artificial Sequence: Synthetic oligonucleotide
  Target: SOD1; (-) strand; PAM type: YTN; PAM sequence: CTT
gactttaaaaaaaaaaaaag

SEQ ID NO: 12834 - DNA, 20 bp, Artificial Sequence
  Description of Artificial Sequence: Synthetic oligonucleotide
  Target: SOD1; (-) strand; PAM type: YTN; PAM sequence: CTC
acttgactttaaaaaaaaaa

SEQ ID NO: 12835 - DNA, 20 bp, Artificial Sequence
  Description of Artificial Sequence: Synthetic oligonucleotide
  Target: SOD1; (-) strand; PAM type: YTN; PAM sequence: TTC
catatggcatactcacttga

SEQ ID NO: 12836 - DNA, 20 bp, Artificial Sequence
  Description of Artificial Sequence: Synthetic oligonucleotide
  Target: SOD1; (-) strand; PAM type: YTN; PAM sequence: TTT
ccatatggcatactcacttg

SEQ ID NO: 12837 - DNA, 20 bp, Artificial Sequence
  Description of Artificial Sequence: Synthetic oligonucleotide
  Target: SOD1; (-) strand; PAM type: YTN; PAM sequence: TTT
tccatatggcatactcactt

SEQ ID NO: 12838 - DNA, 20 bp, Artificial Sequence
  Description of Artificial Sequence: Synthetic oligonucleotide
  Target: SOD1; (-) strand; PAM type: YTN; PAM sequence: CTT
ttccatatggcatactcact

SEQ ID NO: 12839 - DNA, 20 bp, Artificial Sequence
  Description of Artificial Sequence: Synthetic oligonucleotide
  Target: SOD1; (-) strand; PAM type: YTN; PAM sequence: CTC
cacgcacacccttttccata

SEQ ID NO: 12840 - DNA, 20 bp, Artificial Sequence
  Description of Artificial Sequence: Synthetic oligonucleotide
  Target: SOD1; (-) strand; PAM type: YTN; PAM sequence: TTC
tccacgcacacccttttcca

SEQ ID NO: 12841 - DNA, 20 bp, Artificial Sequence
  Description of Artificial Sequence: Synthetic oligonucleotide
  Target: SOD1; (-) strand; PAM type: YTN; PAM sequence: TTT
ctccacgcacacccttttcc

SEQ ID NO: 12842 - DNA, 20 bp, Artificial Sequence
  Description of Artificial Sequence: Synthetic oligonucleotide
  Target: SOD1; (-) strand; PAM type: YTN; PAM sequence: TTT
tctccacgcacacccttttc

SEQ ID NO: 12843 - DNA, 20 bp, Artificial Sequence
  Description of Artificial Sequence: Synthetic oligonucleotide
  Target: SOD1; (-) strand; PAM type: YTN; PAM sequence: TTT
ttctccacgcacaccctttt

SEQ ID NO: 12844 - DNA, 20 bp, Artificial Sequence
  Description of Artificial Sequence: Synthetic oligonucleotide
  Target: SOD1; (-) strand; PAM type: YTN; PAM sequence: CTT
tttctccacgcacacccttt

SEQ ID NO: 12845 - DNA, 20 bp, Artificial Sequence
  Description of Artificial Sequence: Synthetic oligonucleotide
  Target: SOD1; (-) strand; PAM type: YTN; PAM sequence: TTG
ctttttctccacgcacaccc

SEQ ID NO: 12846 - DNA, 20 bp, Artificial Sequence
  Description of Artificial Sequence: Synthetic oligonucleotide
  Target: SOD1; (-) strand; PAM type: YTN; PAM sequence: CTT
gctttttctccacgcacacc

SEQ ID NO: 12847 - DNA, 20 bp, Artificial Sequence
  Description of Artificial Sequence: Synthetic oligonucleotide
  Target: SOD1; (-) strand; PAM type: YTN; PAM sequence: CTG
gagccccttgctttttctcc

SEQ ID NO: 12848 - DNA, 20 bp, Artificial Sequence
  Description of Artificial Sequence: Synthetic oligonucleotide
  Target: SOD1; (-) strand; PAM type: YTN; PAM sequence: CTC
tggagccccttgctttttct

SEQ ID NO: 12849 - DNA, 20 bp, Artificial Sequence
  Description of Artificial Sequence: Synthetic oligonucleotide
  Target: SOD1; (-) strand; PAM type: YTN; PAM sequence: CTA
cactctggagccccttgctt

SEQ ID NO: 12850 - DNA, 20 bp, Artificial Sequence
  Description of Artificial Sequence: Synthetic oligonucleotide
  Target: SOD1; (-) strand; PAM type: YTN; PAM sequence: CTC
atcctacactctggagcccc

SEQ ID NO: 12851 - DNA, 20 bp, Artificial Sequence
  Description of Artificial Sequence: Synthetic oligonucleotide
  Target: SOD1; (-) strand; PAM type: YTN; PAM sequence: TTA
acccaaaaggtgtatgtctc

SEQ ID NO: 12852 - DNA, 20 bp, Artificial Sequence
  Description of Artificial Sequence: Synthetic oligonucleotide
  Target: SOD1; (-) strand; PAM type: YTN; PAM sequence: TTT
aacccaaaaggtgtatgtct

SEQ ID NO: 12853 - DNA, 20 bp, Artificial Sequence
  Description of Artificial Sequence: Synthetic oligonucleotide
  Target: SOD1; (-) strand; PAM type: YTN; PAM sequence: TTT
taacccaaaaggtgtatgtc

SEQ ID NO: 12854 - DNA, 20 bp, Artificial Sequence
  Description of Artificial Sequence: Synthetic oligonucleotide
  Target: SOD1; (-) strand; PAM type: YTN; PAM sequence: TTT
ttaacccaaaaggtgtatgt

SEQ ID NO: 12855 - DNA, 20 bp, Artificial Sequence
  Description of Artificial Sequence: Synthetic oligonucleotide
  Target: SOD1; (-) strand; PAM type: YTN; PAM sequence: CTT
tttaacccaaaaggtgtatg

SEQ ID NO: 12856 - DNA, 20 bp, Artificial Sequence
  Description of Artificial Sequence: Synthetic oligonucleotide
  Target: SOD1; (-) strand; PAM type: YTN; PAM sequence: CTC
agcctttttaacccaaaagg

SEQ ID NO: 12857 - DNA, 20 bp, Artificial Sequence
  Description of Artificial Sequence: Synthetic oligonucleotide
  Target: SOD1; (-) strand; PAM type: YTN; PAM sequence: CTG
cctcagcctttttaacccaa

SEQ ID NO: 12858 - DNA, 20 bp, Artificial Sequence
  Description of Artificial Sequence: Synthetic oligonucleotide
  Target: SOD1; (-) strand; PAM type: YTN; PAM sequence: CTC
ctgcctcagcctttttaacc

SEQ ID NO: 12859 - DNA, 20 bp, Artificial Sequence
  Description of Artificial Sequence: Synthetic oligonucleotide
  Target: SOD1; (-) strand; PAM type: YTN; PAM sequence: TTC
tcctgcctcagcctttttaa

SEQ ID NO: 12860 - DNA, 20 bp, Artificial Sequence
  Description of Artificial Sequence: Synthetic oligonucleotide
  Target: SOD1; (-) strand; PAM type: YTN; PAM sequence: TTC
acgccattctcctgcctcag

SEQ ID NO: 12861 - DNA, 20 bp, Artificial Sequence
  Description of Artificial Sequence: Synthetic oligonucleotide
  Target: SOD1; (-) strand; PAM type: YTN; PAM sequence: CTC
ccgggttcacgccattctcc

SEQ ID NO: 12862 - DNA, 20 bp, Artificial Sequence
  Description of Artificial Sequence: Synthetic oligonucleotide
  Target: SOD1; (-) strand; PAM type: YTN; PAM sequence: CTC
cgcctcccgggttcacgcca

SEQ ID NO: 12863 - DNA, 20 bp, Artificial Sequence
  Description of Artificial Sequence: Synthetic oligonucleotide
  Target: SOD1; (-) strand; PAM type: YTN; PAM sequence: CTG
caagctccgcctcccgggtt

SEQ ID NO: 12864 - DNA, 20 bp, Artificial Sequence
  Description of Artificial Sequence: Synthetic oligonucleotide
  Target: SOD1; (-) strand; PAM type: YTN; PAM sequence: CTC
actgcaagctccgcctcccg

SEQ ID NO: 12865 - DNA, 20 bp, Artificial Sequence
  Description of Artificial Sequence: Synthetic oligonucleotide
  Target: SOD1; (-) strand; PAM type: YTN; PAM sequence: CTC
agctcactgcaagctccgcc

SEQ ID NO: 12866 - DNA, 20 bp, Artificial Sequence
  Description of Artificial Sequence: Synthetic oligonucleotide
  Target: SOD1; (-) strand; PAM type: YTN; PAM sequence: CTG
gagtgcagtggcatgatctc

SEQ ID NO: 12867 - DNA, 20 bp, Artificial Sequence
  Description of Artificial Sequence: Synthetic oligonucleotide
  Target: SOD1; (-) strand; PAM type: YTN; PAM sequence: CTG
tcgcccaggctggagtgcag

SEQ ID NO: 12868 - DNA, 20 bp, Artificial Sequence
  Description of Artificial Sequence: Synthetic oligonucleotide
  Target: SOD1; (-) strand; PAM type: YTN; PAM sequence: CTC
tgtcgcccaggctggagtgc

SEQ ID NO: 12869 - DNA, 20 bp, Artificial Sequence
  Description of Artificial Sequence: Synthetic oligonucleotide
  Target: SOD1; (-) strand; PAM type: YTN; PAM sequence: CTC
gctctgtcgcccaggctgga

SEQ ID NO: 12870 - DNA, 20 bp, Artificial Sequence
  Description of Artificial Sequence: Synthetic oligonucleotide
  Target: SOD1; (-) strand; PAM type: YTN; PAM sequence: TTG
agacaagagtctcgctctgt

SEQ ID NO: 12871 - DNA, 20 bp, Artificial Sequence
  Description of Artificial Sequence: Synthetic oligonucleotide
  Target: SOD1; (-) strand; PAM type: YTN; PAM sequence: TTT
gagacaagagtctcgctctg

SEQ ID NO: 12872 - DNA, 20 bp, Artificial Sequence
  Description of Artificial Sequence: Synthetic oligonucleotide
  Target: SOD1; (-) strand; PAM type: YTN; PAM sequence: TTT
tgagacaagagtctcgctct

SEQ ID NO: 12873 - DNA, 20 bp, Artificial Sequence
  Description of Artificial Sequence: Synthetic oligonucleotide
  Target: SOD1; (-) strand; PAM type: YTN; PAM sequence: TTA
ttttgagacaagagtctcgc

SEQ ID NO: 12874 - DNA, 20 bp, Artificial Sequence
  Description of Artificial Sequence: Synthetic oligonucleotide
  Target: SOD1; (-) strand; PAM type: YTN; PAM sequence: TTT
attttgagacaagagtctcg

SEQ ID NO: 12875 - DNA, 20 bp, Artificial Sequence
  Description of Artificial Sequence: Synthetic oligonucleotide
  Target: SOD1; (-) strand; PAM type: YTN; PAM sequence: TTT
tattttgagacaagagtctc

SEQ ID NO: 12876 - DNA, 20 bp, Artificial Sequence
  Description of Artificial Sequence: Synthetic oligonucleotide
  Target: SOD1; (-) strand; PAM type: YTN; PAM sequence: TTT
ttattttgagacaagagtct

SEQ ID NO: 12877 - DNA, 20 bp, Artificial Sequence
  Description of Artificial Sequence: Synthetic oligonucleotide
  Target: SOD1; (-) strand; PAM type: YTN; PAM sequence: TTT
tttattttgagacaagagtc

SEQ ID NO: 12878 - DNA, 20 bp, Artificial Sequence
  Description of Artificial Sequence: Synthetic oligonucleotide
  Target: SOD1; (-) strand; PAM type: YTN; PAM sequence: TTG
aatatacatgtacatgtaaa

SEQ ID NO: 12879 - DNA, 20 bp, Artificial Sequence
  Description of Artificial Sequence: Synthetic oligonucleotide
  Target: SOD1; (-) strand; PAM type: YTN; PAM sequence: TTG
tacatgttgaatatacatgt

SEQ ID NO: 12880 - DNA, 20 bp, Artificial Sequence
  Description of Artificial Sequence: Synthetic oligonucleotide
  Target: SOD1; (-) strand; PAM type: YTN; PAM sequence: TTT
gtacatgttgaatatacatg

SEQ ID NO: 12881 - DNA, 20 bp, Artificial Sequence
  Description of Artificial Sequence: Synthetic oligonucleotide
  Target: SOD1; (-) strand; PAM type: YTN; PAM sequence: TTA
tatttgtacatgttgaatat

SEQ ID NO: 12882 - DNA, 20 bp, Artificial Sequence
  Description of Artificial Sequence: Synthetic oligonucleotide
  Target: SOD1; (-) strand; PAM type: YTN; PAM sequence: TTG
aataggttatatttgtacat

SEQ ID NO: 12883 - DNA, 20 bp, Artificial Sequence
  Description of Artificial Sequence: Synthetic oligonucleotide
  Target: SOD1; (-) strand; PAM type: YTN; PAM sequence: TTT
gaataggttatatttgtaca

SEQ ID NO: 12884 - DNA, 20 bp, Artificial Sequence
  Description of Artificial Sequence: Synthetic oligonucleotide
  Target: SOD1; (-) strand; PAM type: YTN; PAM sequence: TTT
tgaataggttatatttgtac

SEQ ID NO: 12885 - DNA, 20 bp, Artificial Sequence
  Description of Artificial Sequence: Synthetic oligonucleotide
  Target: SOD1; (-) strand; PAM type: YTN; PAM sequence: CTT
ttgaataggttatatttgta

SEQ ID NO: 12886 - DNA, 20 bp, Artificial Sequence
  Description of Artificial Sequence: Synthetic oligonucleotide
  Target: SOD1; (-) strand; PAM type: YTN; PAM sequence: TTA
tgtagtaaatacttttgaat

SEQ ID NO: 12887 - DNA, 20 bp, Artificial Sequence
  Description of Artificial Sequence: Synthetic oligonucleotide
  Target: SOD1; (-) strand; PAM type: YTN; PAM sequence: TTT
atgtagtaaatacttttgaa

SEQ ID NO: 12888 - DNA, 20 bp, Artificial Sequence
  Description of Artificial Sequence: Synthetic oligonucleotide
  Target: SOD1; (-) strand; PAM type: YTN; PAM sequence: CTA
tttatgtagtaaatactttt

SEQ ID NO: 12889 - DNA, 20 bp, Artificial Sequence
  Description of Artificial Sequence: Synthetic oligonucleotide
  Target: SOD1; (-) strand; PAM type: YTN; PAM sequence: TTA
cagtaaataggtaatgtaag

SEQ ID NO: 12890 - DNA, 20 bp, Artificial Sequence
  Description of Artificial Sequence: Synthetic oligonucleotide
  Target: SOD1; (-) strand; PAM type: YTN; PAM sequence: CTA
ttacagtaaataggtaatgt

SEQ ID NO: 12891 - DNA, 20 bp, Artificial Sequence
  Description of Artificial Sequence: Synthetic oligonucleotide
  Target: SOD1; (-) strand; PAM type: YTN; PAM sequence: TTG
actattacagtaaataggta

SEQ ID NO: 12892 - DNA, 20 bp, Artificial Sequence
  Description of Artificial Sequence: Synthetic oligonucleotide
  Target: SOD1; (-) strand; PAM type: YTN; PAM sequence: TTT
gactattacagtaaataggt

SEQ ID NO: 12893 - DNA, 20 bp, Artificial Sequence
  Description of Artificial Sequence: Synthetic oligonucleotide
  Target: SOD1; (-) strand; PAM type: YTN; PAM sequence: CTT
tgactattacagtaaatagg

SEQ ID NO: 12894 - DNA, 20 bp, Artificial Sequence
  Description of Artificial Sequence: Synthetic oligonucleotide
  Target: SOD1; (-) strand; PAM type: YTN; PAM sequence: TTC
ataggctttgactattacag

SEQ ID NO: 12895 - DNA, 20 bp, Artificial Sequence
  Description of Artificial Sequence: Synthetic oligonucleotide
  Target: SOD1; (-) strand; PAM type: YTN; PAM sequence: CTT
cataggctttgactattaca

SEQ ID NO: 12896 - DNA, 20 bp, Artificial Sequence
  Description of Artificial Sequence: Synthetic oligonucleotide
  Target: SOD1; (-) strand; PAM type: YTN; PAM sequence: TTA
gatacttcataggctttgac

SEQ ID NO: 12897 - DNA, 20 bp, Artificial Sequence
  Description of Artificial Sequence: Synthetic oligonucleotide
  Target: SOD1; (-) strand; PAM type: YTN; PAM sequence: CTA
cacatcagtgttagatactt

SEQ ID NO: 12898 - DNA, 20 bp, Artificial Sequence
  Description of Artificial Sequence: Synthetic oligonucleotide
  Target: SOD1; (-) strand; PAM type: YTN; PAM sequence: CTA
atagagtggcaagcaaagtg

SEQ ID NO: 12899 - DNA, 20 bp, Artificial Sequence
  Description of Artificial Sequence: Synthetic oligonucleotide
  Target: SOD1; (-) strand; PAM type: YTN; PAM sequence: TTA
aataacataaaaagcaccta

SEQ ID NO: 12900 - DNA, 20 bp, Artificial Sequence
  Description of Artificial Sequence: Synthetic oligonucleotide
  Target: SOD1; (-) strand; PAM type: YTN; PAM sequence: TTC
atgattaaataacataaaaa

SEQ ID NO: 12901 - DNA, 20 bp, Artificial Sequence
  Description of Artificial Sequence: Synthetic oligonucleotide
  Target: SOD1; (-) strand; PAM type: YTN; PAM sequence: CTT
catgattaaataacataaaa

SEQ ID NO: 12902 - DNA, 20 bp, Artificial Sequence
  Description of Artificial Sequence: Synthetic oligonucleotide
  Target: SOD1; (-) strand; PAM type: YTN; PAM sequence: CTG
tggccaggcttcatgattaa

SEQ ID NO: 12903 - DNA, 20 bp, Artificial Sequence
  Description of Artificial Sequence: Synthetic oligonucleotide
  Target: SOD1; (-) strand; PAM type: YTN; PAM sequence: CTC
aatgcacaagcaccctgtgg

SEQ ID NO: 12904 - DNA, 20 bp, Artificial Sequence
  Description of Artificial Sequence: Synthetic oligonucleotide
  Target: SOD1; (-) strand; PAM type: YTN; PAM sequence: TTC
ccacactcaatgcacaagca

SEQ ID NO: 12905 - DNA, 20 bp, Artificial Sequence
  Description of Artificial Sequence: Synthetic oligonucleotide
  Target: SOD1; (-) strand; PAM type: YTN; PAM sequence: TTG
ttcccacactcaatgcacaa

SEQ ID NO: 12906 - DNA, 20 bp, Artificial Sequence
  Description of Artificial Sequence: Synthetic oligonucleotide
  Target: SOD1; (-) strand; PAM type: YTN; PAM sequence: CTT
gttcccacactcaatgcaca

SEQ ID NO: 12907 - DNA, 20 bp, Artificial Sequence
  Description of Artificial Sequence: Synthetic oligonucleotide
  Target: SOD1; (-) strand; PAM type: YTN; PAM sequence: CTC
aaaagggagatggtaatctt

SEQ ID NO: 12908 - DNA, 20 bp, Artificial Sequence
  Description of Artificial Sequence: Synthetic oligonucleotide
  Target: SOD1; (-) strand; PAM type: YTN; PAM sequence: CTG
tgtcctcaaaagggagatgg

SEQ ID NO: 12909 - DNA, 20 bp, Artificial Sequence
  Description of Artificial Sequence: Synthetic oligonucleotide
  Target: SOD1; (-) strand; PAM type: YTN; PAM sequence: CTA
ggcctgtgtcctcaaaaggg

SEQ ID NO: 12910 - DNA, 20 bp, Artificial Sequence
  Description of Artificial Sequence: Synthetic oligonucleotide
  Target: SOD1; (-) strand; PAM type: YTN; PAM sequence: CTC
taggcctgtgtcctcaaaag

SEQ ID NO: 12911 - DNA, 20 bp, Artificial Sequence
  Description of Artificial Sequence: Synthetic oligonucleotide
  Target: SOD1; (-) strand; PAM type: YTN; PAM sequence: CTG
ctctaggcctgtgtcctcaa

SEQ ID NO: 12912 - DNA, 20 bp, Artificial Sequence
  Description of Artificial Sequence: Synthetic oligonucleotide
  Target: SOD1; (-) strand; PAM type: YTN; PAM sequence: TTA
actgctctaggcctgtgtcc

SEQ ID NO: 12913 - DNA, 20 bp, Artificial Sequence
  Description of Artificial Sequence: Synthetic oligonucleotide
  Target: SOD1; (-) strand; PAM type: YTN; PAM sequence: CTT
aactgctctaggcctgtgtc

SEQ ID NO: 12914 - DNA, 20 bp, Artificial Sequence
  Description of Artificial Sequence: Synthetic oligonucleotide
  Target: SOD1; (-) strand; PAM type: YTN; PAM sequence: CTG
cttaactgctctaggcctgt

SEQ ID NO: 12915 - DNA, 20 bp, Artificial Sequence
  Description of Artificial Sequence: Synthetic oligonucleotide
  Target: SOD1; (-) strand; PAM type: YTN; PAM sequence: CTC
cagcaagctgcttaactgct

SEQ ID NO: 12916 - DNA, 20 bp, Artificial Sequence
  Description of Artificial Sequence: Synthetic oligonucleotide
  Target: SOD1; (-) strand; PAM type: YTN; PAM sequence: CTA
gccagtgaacctccagcaag

SEQ ID NO: 12917 - DNA, 20 bp, Artificial Sequence
  Description of Artificial Sequence: Synthetic oligonucleotide
  Target: SOD1; (-) strand; PAM type: YTN; PAM sequence: TTC
tagccagtgaacctccagca

SEQ ID NO: 12918 - DNA, 20 bp, Artificial Sequence
  Description of Artificial Sequence: Synthetic oligonucleotide
  Target: SOD1; (-) strand; PAM type: YTN; PAM sequence: TTT
ctagccagtgaacctccagc

SEQ ID NO: 12919 - DNA, 20 bp, Artificial Sequence
  Description of Artificial Sequence: Synthetic oligonucleotide
  Target: SOD1; (-) strand; PAM type: YTN; PAM sequence: CTT
tctagccagtgaacctccag

SEQ ID NO: 12920 - DNA, 20 bp, Artificial Sequence
  Description of Artificial Sequence: Synthetic oligonucleotide
  Target: SOD1; (-) strand; PAM type: YTN; PAM sequence: CTG
accactttctagccagtgaa

SEQ ID NO: 12921 - DNA, 20 bp, Artificial Sequence
  Description of Artificial Sequence: Synthetic oligonucleotide
  Target: SOD1; (-) strand; PAM type: YTN; PAM sequence: CTG
tgtccaaatcccaggctgac

SEQ ID NO: 12922 - DNA, 20 bp, Artificial Sequence
  Description of Artificial Sequence: Synthetic oligonucleotide
  Target: SOD1; (-) strand; PAM type: YTN; PAM sequence: TTG
ggagtggaaaaatctgtgtc

SEQ ID NO: 12923 - DNA, 20 bp, Artificial Sequence
  Description of Artificial Sequence: Synthetic oligonucleotide
  Target: SOD1; (-) strand; PAM type: YTN; PAM sequence: CTT
gggagtggaaaaatctgtgt

SEQ ID NO: 12924 - DNA, 20 bp, Artificial Sequence
  Description of Artificial Sequence: Synthetic oligonucleotide
  Target: SOD1; (-) strand; PAM type: YTN; PAM sequence: CTC
acagtgaagtaaaaagcagc

SEQ ID NO: 12925 - DNA, 20 bp, Artificial Sequence
  Description of Artificial Sequence: Synthetic oligonucleotide
  Target: SOD1; (-) strand; PAM type: YTN; PAM sequence: TTA
cccctcacagtgaagtaaaa

SEQ ID NO: 12926 - DNA, 20 bp, Artificial Sequence
  Description of Artificial Sequence: Synthetic oligonucleotide
  Target: SOD1; (-) strand; PAM type: YTN; PAM sequence: TTT
acccctcacagtgaagtaaa

SEQ ID NO: 12927 - DNA, 20 bp, Artificial Sequence
  Description of Artificial Sequence: Synthetic oligonucleotide
  Target: SOD1; (-) strand; PAM type: YTN; PAM sequence: CTT
tacccctcacagtgaagtaa

SEQ ID NO: 12928 - DNA, 20 bp, Artificial Sequence
  Description of Artificial Sequence: Synthetic oligonucleotide
  Target: SOD1; (-) strand; PAM type: YTN; PAM sequence: TTA
cctttacccctcacagtgaa

SEQ ID NO: 12929 - DNA, 20 bp, Artificial Sequence
  Description of Artificial Sequence: Synthetic oligonucleotide
  Target: SOD1; (-) strand; PAM type: YTN; PAM sequence: TTT
acctttacccctcacagtga

SEQ ID NO: 12930 - DNA, 20 bp, Artificial Sequence
  Description of Artificial Sequence: Synthetic oligonucleotide
  Target: SOD1; (-) strand; PAM type: YTN; PAM sequence: CTG
atttacctttacccctcaca

SEQ ID NO: 12931 - DNA, 20 bp, Artificial Sequence
  Description of Artificial Sequence: Synthetic oligonucleotide
  Target: SOD1; (-) strand; PAM type: YTN; PAM sequence: CTG
aacaaagaaaacagctgatt

SEQ ID NO: 12932 - DNA, 20 bp, Artificial Sequence
  Description of Artificial Sequence: Synthetic oligonucleotide
  Target: SOD1; (-) strand; PAM type: YTN; PAM sequence: TTC
tgaacaaagaaaacagctga

SEQ ID NO: 12933 - DNA, 20 bp, Artificial Sequence
  Description of Artificial Sequence: Synthetic oligonucleotide
  Target: SOD1; (-) strand; PAM type: YTN; PAM sequence: TTT
ctgaacaaagaaaacagctg

SEQ ID NO: 12934 - DNA, 20 bp, Artificial Sequence
  Description of Artificial Sequence: Synthetic oligonucleotide
  Target: SOD1; (-) strand; PAM type: YTN; PAM sequence: TTG
gagagagtttctgaacaaag

SEQ ID NO: 12935 - DNA, 20 bp, Artificial Sequence
  Description of Artificial Sequence: Synthetic oligonucleotide
  Target: SOD1; (-) strand; PAM type: YTN; PAM sequence: TTA
agaaaagtgcaaagttggag

SEQ ID NO: 12936 - DNA, 20 bp, Artificial Sequence
  Description of Artificial Sequence: Synthetic oligonucleotide
  Target: SOD1; (-) strand; PAM type: YTN; PAM sequence: TTT
aagaaaagtgcaaagttgga

SEQ ID NO: 12937 - DNA, 20 bp, Artificial Sequence
  Description of Artificial Sequence: Synthetic oligonucleotide
  Target: SOD1; (-) strand; PAM type: YTN; PAM sequence: CTT
taagaaaagtgcaaagttgg

SEQ ID NO: 12938 - DNA, 20 bp, Artificial Sequence
  Description of Artificial Sequence: Synthetic oligonucleotide
  Target: SOD1; (-) strand; PAM type: YTN; PAM sequence: TTC
ctttaagaaaagtgcaaagt

SEQ ID NO: 12939 - DNA, 20 bp, Artificial Sequence
  Description of Artificial Sequence: Synthetic oligonucleotide
  Target: SOD1; (-) strand; PAM type: YTN; PAM sequence: TTT
cctttaagaaaagtgcaaag

SEQ ID NO: 12940 - DNA, 20 bp, Artificial Sequence
  Description of Artificial Sequence: Synthetic oligonucleotide
  Target: SOD1; (-) strand; PAM type: YTN; PAM sequence: CTT
tcctttaagaaaagtgcaaa

SEQ ID NO: 12941 - DNA, 20 bp, Artificial Sequence
  Description of Artificial Sequence: Synthetic oligonucleotide
  Target: SOD1; (-) strand; PAM type: YTN; PAM sequence: TTA
ctttcctttaagaaaagtgc

SEQ ID NO: 12942 - DNA, 20 bp, Artificial Sequence
  Description of Artificial Sequence: Synthetic oligonucleotide
  Target: SOD1; (-) strand; PAM type: YTN; PAM sequence: CTG
gtccattactttcctttaag

SEQ ID NO: 12943 - DNA, 20 bp, Artificial Sequence
  Description of Artificial Sequence: Synthetic oligonucleotide
  Target: SOD1; (-) strand; PAM type: YTN; PAM sequence: TTC
actggtccattactttcctt

SEQ ID NO: 12944 - DNA, 20 bp, Artificial Sequence
  Description of Artificial Sequence: Synthetic oligonucleotide
  Target: SOD1; (-) strand; PAM type: YTN; PAM sequence: CTT
cactggtccattactttcct

SEQ ID NO: 12945 - DNA, 20 bp, Artificial Sequence
  Description of Artificial Sequence: Synthetic oligonucleotide
  Target: SOD1; (-) strand; PAM type: YTN; PAM sequence: TTC
cccacaccttcactggtcca

SEQ ID NO: 12946 - DNA, 20 bp, Artificial Sequence
  Description of Artificial Sequence: Synthetic oligonucleotide
  Target: SOD1; (-) strand; PAM type: YTN; PAM sequence: CTT
ccccacaccttcactggtcc

SEQ ID NO: 12947 - DNA, 20 bp, Artificial Sequence
  Description of Artificial Sequence: Synthetic oligonucleotide
  Target: SOD1; (-) strand; PAM type: YTN; PAM sequence: TTA
atgcttccccacaccttcac

SEQ ID NO: 12948 - DNA, 20 bp, Artificial Sequence
  Description of Artificial Sequence: Synthetic oligonucleotide
  Target: SOD1; (-) strand; PAM type: YTN; PAM sequence: TTT
aatgcttccccacaccttca

SEQ ID NO: 12949 - DNA, 20 bp, Artificial Sequence
  Description of Artificial Sequence: Synthetic oligonucleotide
  Target: SOD1; (-) strand; PAM type: YTN; PAM sequence: CTT
taatgcttccccacaccttc

SEQ ID NO: 12950 - DNA, 20 bp, Artificial Sequence
  Description of Artificial Sequence: Synthetic oligonucleotide
  Target: SOD1; (-) strand; PAM type: YTN; PAM sequence: TTC
agtcagtcctttaatgcttc

SEQ ID NO: 12951 - DNA, 20 bp, Artificial Sequence
  Description of Artificial Sequence: Synthetic oligonucleotide
  Target: SOD1; (-) strand; PAM type: YTN; PAM sequence: CTT
cagtcagtcctttaatgctt

SEQ ID NO: 12952 - DNA, 20 bp, Artificial Sequence
  Description of Artificial Sequence: Synthetic oligonucleotide
  Target: SOD1; (-) strand; PAM type: YTN; PAM sequence: CTC
atgaacatggaatccatgca

SEQ ID NO: 12953 - DNA, 20 bp, Artificial Sequence
  Description of Artificial Sequence: Synthetic oligonucleotide
  Target: SOD1; (-) strand; PAM type: YTN; PAM sequence: CTC
caaactcatgaacatggaat

SEQ ID NO: 12954 - DNA, 20 bp, Artificial Sequence
  Description of Artificial Sequence: Synthetic oligonucleotide
  Target: SOD1; (-) strand; PAM type: YTN; PAM sequence: TTA
tctccaaactcatgaacatg

SEQ ID NO: 12955 - DNA, 20 bp, Artificial Sequence
  Description of Artificial Sequence: Synthetic oligonucleotide
  Target: SOD1; (-) strand; PAM type: YTN; PAM sequence: CTG
tattatctccaaactcatga

SEQ ID NO: 12956 - DNA, 20 bp, Artificial Sequence
  Description of Artificial Sequence: Synthetic oligonucleotide
  Target: SOD1; (-) strand; PAM type: YTN; PAM sequence: CTG
ctgtattatctccaaactca

SEQ ID NO: 12957 - DNA, 20 bp, Artificial Sequence
  Description of Artificial Sequence: Synthetic oligonucleotide
  Target: SOD1; (-) strand; PAM type: YTN; PAM sequence: CTA
gggtgaacaagtatgggtca

SEQ ID NO: 12958 - DNA, 20 bp, Artificial Sequence
  Description of Artificial Sequence: Synthetic oligonucleotide
  Target: SOD1; (-) strand; PAM type: YTN; PAM sequence: CTA
actagggtgaacaagtatgg

SEQ ID NO: 12959 - DNA, 20 bp, Artificial Sequence
  Description of Artificial Sequence: Synthetic oligonucleotide
  Target: SOD1; (-) strand; PAM type: YTN; PAM sequence: TTA
tctaactagggtgaacaagt

SEQ ID NO: 12960 - DNA, 20 bp, Artificial Sequence
  Description of Artificial Sequence: Synthetic oligonucleotide
  Target: SOD1; (-) strand; PAM type: YTN; PAM sequence: TTT
atctaactagggtgaacaag

SEQ ID NO: 12961 - DNA, 20 bp, Artificial Sequence
  Description of Artificial Sequence: Synthetic oligonucleotide
  Target: SOD1; (-) strand; PAM type: YTN; PAM sequence: CTG
tttatctaactagggtgaac

SEQ ID NO: 12962 - DNA, 20 bp, Artificial Sequence
  Description of Artificial Sequence: Synthetic oligonucleotide
  Target: SOD1; (-) strand; PAM type: YTN; PAM sequence: CTA
ctgtttatctaactagggtg

SEQ ID NO: 12963 - DNA, 20 bp, Artificial Sequence
  Description of Artificial Sequence: Synthetic oligonucleotide
  Target: SOD1; (-) strand; PAM type: YTN; PAM sequence: CTC
tactgtttatctaactaggg

SEQ ID NO: 12964 - DNA, 20 bp, Artificial Sequence
  Description of Artificial Sequence: Synthetic oligonucleotide
  Target: SOD1; (-) strand; PAM type: YTN; PAM sequence: CTA
ctctactgtttatctaacta

SEQ ID NO: 12965 - DNA, 20 bp, Artificial Sequence
  Description of Artificial Sequence: Synthetic oligonucleotide
  Target: SOD1; (-) strand; PAM type: YTN; PAM sequence: TTA
ggggctactctactgtttat

SEQ ID NO: 12966 - DNA, 20 bp, Artificial Sequence
  Description of Artificial Sequence: Synthetic oligonucleotide
  Target: SOD1; (-) strand; PAM type: YTN; PAM sequence: TTT
aggggctactctactgttta

SEQ ID NO: 12967 - DNA, 20 bp, Artificial Sequence
  Description of Artificial Sequence: Synthetic oligonucleotide
  Target: SOD1; (-) strand; PAM type: YTN; PAM sequence: TTA
acgtttaggggctactctac

SEQ ID NO: 12968 - DNA, 20 bp, Artificial Sequence
  Description of Artificial Sequence: Synthetic oligonucleotide
  Target: SOD1; (-) strand; PAM type: YTN; PAM sequence: TTT
aacgtttaggggctactcta

SEQ ID NO: 12969 - DNA, 20 bp, Artificial Sequence
  Description of Artificial Sequence: Synthetic oligonucleotide
  Target: SOD1; (-) strand; PAM type: YTN; PAM sequence: TTT
taacgtttaggggctactct

SEQ ID NO: 12970 - DNA, 20 bp, Artificial Sequence
  Description of Artificial Sequence: Synthetic oligonucleotide
  Target: SOD1; (-) strand; PAM type: YTN; PAM sequence: TTG
aggggttttaacgtttaggg

SEQ ID NO: 12971 - DNA, 20 bp, Artificial Sequence
  Description of Artificial Sequence: Synthetic oligonucleotide
  Target: SOD1; (-) strand; PAM type: YTN; PAM sequence: CTC
aaaaacaaaaacaagttgag

SEQ ID NO: 12972 - DNA, 20 bp, Artificial Sequence
  Description of Artificial Sequence: Synthetic oligonucleotide
  Target: SOD1; (-) strand; PAM type: YTN; PAM sequence: TTC
tcaaaaacaaaaacaagttg

SEQ ID NO: 12973 - DNA, 20 bp, Artificial Sequence
  Description of Artificial Sequence: Synthetic oligonucleotide
  Target: SOD1; (-) strand; PAM type: YTN; PAM sequence: TTT
ctcaaaaacaaaaacaagtt

SEQ ID NO: 12974 - DNA, 20 bp, Artificial Sequence
  Description of Artificial Sequence: Synthetic oligonucleotide
  Target: SOD1; (-) strand; PAM type: YTN; PAM sequence: CTT
tctcaaaaacaaaaacaagt

SEQ ID NO: 12975 - DNA, 20 bp, Artificial Sequence
  Description of Artificial Sequence: Synthetic oligonucleotide
  Target: SOD1; (-) strand; PAM type: YTN; PAM sequence: CTG
agcgacagagcaagaccctt

SEQ ID NO: 12976 - DNA, 20 bp, Artificial Sequence
  Description of Artificial Sequence: Synthetic oligonucleotide
  Target: SOD1; (-) strand; PAM type: YTN; PAM sequence: CTC
cagcctgagcgacagagcaa

SEQ ID NO: 12977 - DNA, 20 bp, Artificial Sequence
  Description of Artificial Sequence: Synthetic oligonucleotide
  Target: SOD1; (-) strand; PAM type: YTN; PAM sequence: CTG
cactccagcctgagcgacag

SEQ ID NO: 12978 - DNA, 20 bp, Artificial Sequence
  Description of Artificial Sequence: Synthetic oligonucleotide
  Target: SOD1; (-) strand; PAM type: YTN; PAM sequence: CTA
aggtcagccatgatcgcaca

SEQ ID NO: 12979 - DNA, 20 bp, Artificial Sequence
  Description of Artificial Sequence: Synthetic oligonucleotide
  Target: SOD1; (-) strand; PAM type: YTN; PAM sequence: CTG
ggaggtcaaggctaaggtca

SEQ ID NO: 12980 - DNA, 20 bp, Artificial Sequence
  Description of Artificial Sequence: Synthetic oligonucleotide
  Target: SOD1; (-) strand; PAM type: YTN; PAM sequence: CTA
cgggccaaggcatgaggatc

SEQ ID NO: 12981 - DNA, 20 bp, Artificial Sequence
  Description of Artificial Sequence: Synthetic oligonucleotide
  Target: SOD1; (-) strand; PAM type: YTN; PAM sequence: CTG
tagtcccagctacgggccaa

SEQ ID NO: 12982 - DNA, 20 bp, Artificial Sequence
  Description of Artificial Sequence: Synthetic oligonucleotide
  Target: SOD1; (-) strand; PAM type: YTN; PAM sequence: TTA
gccaggcgtggtggtgtgta

SEQ ID NO: 12983 - DNA, 20 bp, Artificial Sequence
  Description of Artificial Sequence: Synthetic oligonucleotide
  Target: SOD1; (-) strand; PAM type: YTN; PAM sequence: CTA
gaaaaaaatacaaaaattag

SEQ ID NO: 12984 - DNA, 20 bp, Artificial Sequence
  Description of Artificial Sequence: Synthetic oligonucleotide
  Target: SOD1; (-) strand; PAM type: YTN; PAM sequence: CTC
tagaaaaaaatacaaaaatt

SEQ ID NO: 12985 - DNA, 20 bp, Artificial Sequence
  Description of Artificial Sequence: Synthetic oligonucleotide
  Target: SOD1; (-) strand; PAM type: YTN; PAM sequence: CTG
ggcaacatgatgaaacccca

SEQ ID NO: 12986 - DNA, 20 bp, Artificial Sequence
  Description of Artificial Sequence: Synthetic oligonucleotide
  Target: SOD1; (-) strand; PAM type: YTN; PAM sequence: TTC
aagaccagcctgggcaacat

SEQ ID NO: 12987 - DNA, 20 bp, Artificial Sequence
  Description of Artificial Sequence: Synthetic oligonucleotide
  Target: SOD1; (-) strand; PAM type: YTN; PAM sequence: TTG
agcccagcagttcaagacca

SEQ ID NO: 12988 - DNA, 20 bp, Artificial Sequence
  Description of Artificial Sequence: Synthetic oligonucleotide
  Target: SOD1; (-) strand; PAM type: YTN; PAM sequence: CTT
gagcccagcagttcaagacc

SEQ ID NO: 12989 - DNA, 20 bp, Artificial Sequence
  Description of Artificial Sequence: Synthetic oligonucleotide
  Target: SOD1; (-) strand; PAM type: YTN; PAM sequence: TTG
ggaggtcgaggaggatagac

SEQ ID NO: 12990 - DNA, 20 bp, Artificial Sequence
  Description of Artificial Sequence: Synthetic oligonucleotide
  Target: SOD1; (-) strand; PAM type: YTN; PAM sequence: TTT
gggaggtcgaggaggataga

SEQ ID NO: 12991 - DNA, 20 bp, Artificial Sequence
  Description of Artificial Sequence: Synthetic oligonucleotide
  Target: SOD1; (-) strand; PAM type: YTN; PAM sequence: CTT
tgggaggtcgaggaggatag

SEQ ID NO: 12992 - DNA, 20 bp, Artificial Sequence
  Description of Artificial Sequence: Synthetic oligonucleotide
  Target: SOD1; (-) strand; PAM type: YTN; PAM sequence: CTC
acacatgtaatcccagcact

SEQ ID NO: 12993 - DNA, 20 bp, Artificial Sequence
  Description of Artificial Sequence: Synthetic oligonucleotide
  Target: SOD1; (-) strand; PAM type: YTN; PAM sequence: TTC
ccaggcacagtggctcacac

SEQ ID NO: 12994 - DNA, 20 bp, Artificial Sequence
  Description of Artificial Sequence: Synthetic oligonucleotide
  Target: SOD1; (-) strand; PAM type: YTN; PAM sequence: TTT
cccaggcacagtggctcaca

SEQ ID NO: 12995 - DNA, 20 bp, Artificial Sequence
  Description of Artificial Sequence: Synthetic oligonucleotide
  Target: SOD1; (-) strand; PAM type: YTN; PAM sequence: TTT
tcccaggcacagtggctcac

SEQ ID NO: 12996 - DNA, 20 bp, Artificial Sequence
  Description of Artificial Sequence: Synthetic oligonucleotide
  Target: SOD1; (-) strand; PAM type: YTN; PAM sequence: TTG
agggttttcccaggcacagt

SEQ ID NO: 12997 - DNA, 20 bp, Artificial Sequence
  Description of Artificial Sequence: Synthetic oligonucleotide
  Target: SOD1; (-) strand; PAM type: YTN; PAM sequence: TTA
aaagaaaagttgagggtttt

SEQ ID NO: 12998 - DNA, 20 bp, Artificial Sequence
  Description of Artificial Sequence: Synthetic oligonucleotide
  Target: SOD1; (-) strand; PAM type: YTN; PAM sequence: TTT
aaaagaaaagttgagggttt

SEQ ID NO: 12999 - DNA, 20 bp, Artificial Sequence
  Description of Artificial Sequence: Synthetic oligonucleotide
  Target: SOD1; (-) strand; PAM type: YTN; PAM sequence: TTT
taaaagaaaagttgagggtt

SEQ ID NO: 13000 - DNA, 20 bp, Artificial Sequence
  Description of Artificial Sequence: Synthetic oligonucleotide
  Target: SOD1; (-) strand; PAM type: YTN; PAM sequence: TTT
ttaaaagaaaagttgagggt

SEQ ID NO: 13001 - DNA, 20 bp, Artificial Sequence
  Description of Artificial Sequence: Synthetic oligonucleotide
  Target: SOD1; (-) strand; PAM type: YTN; PAM sequence: TTT
tttaaaagaaaagttgaggg

SEQ ID NO: 13002 - DNA, 20 bp, Artificial Sequence
  Description of Artificial Sequence: Synthetic oligonucleotide
  Target: SOD1; (-) strand; PAM type: YTN; PAM sequence: CTT
ttttaaaagaaaagttgagg

SEQ ID NO: 13003 - DNA, 20 bp, Artificial Sequence
  Description of Artificial Sequence: Synthetic oligonucleotide
  Target: SOD1; (-) strand; PAM type: YTN; PAM sequence: CTC
ttttttaaaagaaaagttga

SEQ ID NO: 13004 - DNA, 20 bp, Artificial Sequence
  Description of Artificial Sequence: Synthetic oligonucleotide
  Target: SOD1; (-) strand; PAM type: YTN; PAM sequence: TTG
acctcttttttaaaagaaaa

SEQ ID NO: 13005 - DNA, 20 bp, Artificial Sequence
  Description of Artificial Sequence: Synthetic oligonucleotide
  Target: SOD1; (-) strand; PAM type: YTN; PAM sequence: TTA
tatacaataaagttgacctc

SEQ ID NO: 13006 - DNA, 20 bp, Artificial Sequence
  Description of Artificial Sequence: Synthetic oligonucleotide
  Target: SOD1; (-) strand; PAM type: YTN; PAM sequence: CTT
atatacaataaagttgacct

SEQ ID NO: 13007 - DNA, 20 bp, Artificial Sequence
  Description of Artificial Sequence: Synthetic oligonucleotide
  Target: SOD1; (-) strand; PAM type: YTN; PAM sequence: TTA
gcacagtgcttatatacaat

SEQ ID NO: 13008 - DNA, 20 bp, Artificial Sequence
  Description of Artificial Sequence: Synthetic oligonucleotide
  Target: SOD1; (-) strand; PAM type: YTN; PAM sequence: TTT
agcacagtgcttatatacaa

SEQ ID NO: 13009 - DNA, 20 bp, Artificial Sequence
  Description of Artificial Sequence: Synthetic oligonucleotide
  Target: SOD1; (-) strand; PAM type: YTN; PAM sequence: TTT
tagcacagtgcttatataca

SEQ ID NO: 13010 - DNA, 20 bp, Artificial Sequence
  Description of Artificial Sequence: Synthetic oligonucleotide
  Target: SOD1; (-) strand; PAM type: YTN; PAM sequence: CTG
caattttagcacagtgctta

SEQ ID NO: 13011 - DNA, 20 bp, Artificial Sequence
  Description of Artificial Sequence: Synthetic oligonucleotide
  Target: SOD1; (-) strand; PAM type: YTN; PAM sequence: TTC
ctgcaattttagcacagtgc

SEQ ID NO: 13012 - DNA, 20 bp, Artificial Sequence
  Description of Artificial Sequence: Synthetic oligonucleotide
  Target: SOD1; (-) strand; PAM type: YTN; PAM sequence: TTA
caaaaatcaggatatggtcc

SEQ ID NO: 13013 - DNA, 20 bp, Artificial Sequence
  Description of Artificial Sequence: Synthetic oligonucleotide
  Target: SOD1; (-) strand; PAM type: YTN; PAM sequence: TTA
ttacaaaaatcaggatatgg

SEQ ID NO: 13014 - DNA, 20 bp, Artificial Sequence
  Description of Artificial Sequence: Synthetic oligonucleotide
  Target: SOD1; (-) strand; PAM type: YTN; PAM sequence: CTG
gcattattacaaaaatcagg

SEQ ID NO: 13015 - DNA, 20 bp, Artificial Sequence
  Description of Artificial Sequence: Synthetic oligonucleotide
  Target: SOD1; (-) strand; PAM type: YTN; PAM sequence: CTG
ctggcattattacaaaaatc

SEQ ID NO: 13016 - DNA, 20 bp, Artificial Sequence
  Description of Artificial Sequence: Synthetic oligonucleotide
  Target: SOD1; (-) strand; PAM type: YTN; PAM sequence: CTC
tgctggcattattacaaaaa

SEQ ID NO: 13017 - DNA, 20 bp, Artificial Sequence
  Description of Artificial Sequence: Synthetic oligonucleotide
  Target: SOD1; (-) strand; PAM type: YTN; PAM sequence: TTG
tgtgtactctgctggcatta

SEQ ID NO: 13018 - DNA, 20 bp, Artificial Sequence
  Description of Artificial Sequence: Synthetic oligonucleotide
  Target: SOD1; (-) strand; PAM type: YTN; PAM sequence: CTT
gtgtgtactctgctggcatt

SEQ ID NO: 13019 - DNA, 20 bp, Artificial Sequence
  Description of Artificial Sequence: Synthetic oligonucleotide
  Target: SOD1; (-) strand; PAM type: YTN; PAM sequence: TTC
ttgtgtgtactctgctggca

SEQ ID NO: 13020 - DNA, 20 bp, Artificial Sequence
  Description of Artificial Sequence: Synthetic oligonucleotide
  Target: SOD1; (-) strand; PAM type: YTN; PAM sequence: TTT
cttgtgtgtactctgctggc

SEQ ID NO: 13021 - DNA, 20 bp, Artificial Sequence
  Description of Artificial Sequence: Synthetic oligonucleotide
  Target: SOD1; (-) strand; PAM type: YTN; PAM sequence: TTT
tcttgtgtgtactctgctgg

SEQ ID NO: 13022 - DNA, 20 bp, Artificial Sequence
  Description of Artificial Sequence: Synthetic oligonucleotide
  Target: SOD1; (-) strand; PAM type: YTN; PAM sequence: CTT
ttcttgtgtgtactctgctg

SEQ ID NO: 13023 - DNA, 20 bp, Artificial Sequence
  Description of Artificial Sequence: Synthetic oligonucleotide
  Target: SOD1; (-) strand; PAM type: YTN; PAM sequence: TTA
cttttcttgtgtgtactctg

SEQ ID NO: 13024 - DNA, 20 bp, Artificial Sequence
  Description of Artificial Sequence: Synthetic oligonucleotide
  Target: SOD1; (-) strand; PAM type: YTN; PAM sequence: CTA
gtgcagttacttttcttgtg

SEQ ID NO: 13025 - DNA, 20 bp, Artificial Sequence
  Description of Artificial Sequence: Synthetic oligonucleotide
  Target: SOD1; (-) strand; PAM type: YTN; PAM sequence: TTC
acaatctagtgcagttactt

SEQ ID NO: 13026 - DNA, 20 bp, Artificial Sequence
  Description of Artificial Sequence: Synthetic oligonucleotide
  Target: SOD1; (-) strand; PAM type: YTN; PAM sequence: CTT
cacaatctagtgcagttact

SEQ ID NO: 13027 - DNA, 20 bp, Artificial Sequence
  Description of Artificial Sequence: Synthetic oligonucleotide
  Target: SOD1; (-) strand; PAM type: YTN; PAM sequence: TTC
agaagcaggtccaccccagt

SEQ ID NO: 13028 - DNA, 20 bp, Artificial Sequence
  Description of Artificial Sequence: Synthetic oligonucleotide
  Target: SOD1; (-) strand; PAM type: YTN; PAM sequence: CTT
cagaagcaggtccaccccag

SEQ ID NO: 13029 - DNA, 20 bp, Artificial Sequence
  Description of Artificial Sequence: Synthetic oligonucleotide
  Target: SOD1; (-) strand; PAM type: YTN; PAM sequence: CTG
gaccttcagaagcaggtcca

SEQ ID NO: 13030 - DNA, 20 bp, Artificial Sequence
  Description of Artificial Sequence: Synthetic oligonucleotide
  Target: SOD1; (-) strand; PAM type: YTN; PAM sequence: TTA
agacaaagggcactggacct

SEQ ID NO: 13031 - DNA, 20 bp, Artificial Sequence
  Description of Artificial Sequence: Synthetic oligonucleotide
  Target: SOD1; (-) strand; PAM type: YTN; PAM sequence: CTT
aagacaaagggcactggacc

SEQ ID NO: 13032 - DNA, 20 bp, Artificial Sequence
  Description of Artificial Sequence: Synthetic oligonucleotide
  Target: SOD1; (-) strand; PAM type: YTN; PAM sequence: CTA
caccaaatcttaagacaaag

SEQ ID NO: 13033 - DNA, 20 bp, Artificial Sequence
  Description of Artificial Sequence: Synthetic oligonucleotide
  Target: SOD1; (-) strand; PAM type: YTN; PAM sequence: CTA
aagacacactacaccaaatc

SEQ ID NO: 13034 - DNA, 20 bp, Artificial Sequence
  Description of Artificial Sequence: Synthetic oligonucleotide
  Target: SOD1; (-) strand; PAM type: YTN; PAM sequence: TTC
taaagacacactacaccaaa

SEQ ID NO: 13035 - DNA, 20 bp, Artificial Sequence
  Description of Artificial Sequence: Synthetic oligonucleotide
  Target: SOD1; (-) strand; PAM type: YTN; PAM sequence: TTT
ctaaagacacactacaccaa

SEQ ID NO: 13036 - DNA, 20 bp, Artificial Sequence
  Description of Artificial Sequence: Synthetic oligonucleotide
  Target: SOD1; (-) strand; PAM type: YTN; PAM sequence: TTG
gtttctaaagacacactaca

SEQ ID NO: 13037 - DNA, 20 bp, Artificial Sequence
  Description of Artificial Sequence: Synthetic oligonucleotide
  Target: SOD1; (-) strand; PAM type: YTN; PAM sequence: TTT
ggtttctaaagacacactac

SEQ ID NO: 13038 - DNA, 20 bp, Artificial Sequence
  Description of Artificial Sequence: Synthetic oligonucleotide
  Target: SOD1; (-) strand; PAM type: YTN; PAM sequence: TTT
tggtttctaaagacacacta

SEQ ID NO: 13039 - DNA, 20 bp, Artificial Sequence
  Description of Artificial Sequence: Synthetic oligonucleotide
  Target: SOD1; (-) strand; PAM type: YTN; PAM sequence: TTT
ttggtttctaaagacacact

SEQ ID NO: 13040 - DNA, 20 bp, Artificial Sequence
  Description of Artificial Sequence: Synthetic oligonucleotide
  Target: SOD1; (-) strand; PAM type: YTN; PAM sequence: TTT
tttggtttctaaagacacac

SEQ ID NO: 13041 - DNA, 20 bp, Artificial Sequence
  Description of Artificial Sequence: Synthetic oligonucleotide
  Target: SOD1; (-) strand; PAM type: YTN; PAM sequence: TTT
ttttggtttctaaagacaca

SEQ ID NO: 13042 - DNA, 20 bp, Artificial Sequence
  Description of Artificial Sequence: Synthetic oligonucleotide
  Target: SOD1; (-) strand; PAM type: YTN; PAM sequence: CTT
tttttggtttctaaagacac

SEQ ID NO: 13043 - DNA, 20 bp, Artificial Sequence
  Description of Artificial Sequence: Synthetic oligonucleotide
  Target: SOD1; (-) strand; PAM type: YTN; PAM sequence: CTC
tttttttggtttctaaagac

SEQ ID NO: 13044 - DNA, 20 bp, Artificial Sequence
  Description of Artificial Sequence: Synthetic oligonucleotide
  Target: SOD1; (-) strand; PAM type: YTN; PAM sequence: TTC
tctttttttggtttctaaag

SEQ ID NO: 13045 - DNA, 20 bp, Artificial Sequence
  Description of Artificial Sequence: Synthetic oligonucleotide
  Target: SOD1; (-) strand; PAM type: YTN; PAM sequence: CTT
ctctttttttggtttctaaa

SEQ ID NO: 13046 - DNA, 20 bp, Artificial Sequence
  Description of Artificial Sequence: Synthetic oligonucleotide
  Target: SOD1; (-) strand; PAM type: YTN; PAM sequence: TTC
ttctctttttttggtttcta

SEQ ID NO: 13047 - DNA, 20 bp, Artificial Sequence
  Description of Artificial Sequence: Synthetic oligonucleotide
  Target: SOD1; (-) strand; PAM type: YTN; PAM sequence: CTT
cttctctttttttggtttct

SEQ ID NO: 13048 - DNA, 20 bp, Artificial Sequence
  Description of Artificial Sequence: Synthetic oligonucleotide
  Target: SOD1; (-) strand; PAM type: YTN; PAM sequence: TTG
atcttcttctctttttttgg

SEQ ID NO: 13049 - DNA, 20 bp, Artificial Sequence
  Description of Artificial Sequence: Synthetic oligonucleotide
  Target: SOD1; (-) strand; PAM type: YTN; PAM sequence: TTA
aggttgatcttcttctcttt

SEQ ID NO: 13050 - DNA, 20 bp, Artificial Sequence
  Description of Artificial Sequence: Synthetic oligonucleotide
  Target: SOD1; (-) strand; PAM type: YTN; PAM sequence: CTT
aaggttgatcttcttctctt

SEQ ID NO: 13051 - DNA, 20 bp, Artificial Sequence
  Description of Artificial Sequence: Synthetic oligonucleotide
  Target: SOD1; (-) strand; PAM type: YTN; PAM sequence: CTA
atcttaaggttgatcttctt

SEQ ID NO: 13052 - DNA, 20 bp, Artificial Sequence
  Description of Artificial Sequence: Synthetic oligonucleotide
  Target: SOD1; (-) strand; PAM type: YTN; PAM sequence: TTG
tggctaatcttaaggttgat

SEQ ID NO: 13053 - DNA, 20 bp, Artificial Sequence
  Description of Artificial Sequence: Synthetic oligonucleotide
  Target: SOD1; (-) strand; PAM type: YTN; PAM sequence: TTT
gtggctaatcttaaggttga

SEQ ID NO: 13054 - DNA, 20 bp, Artificial Sequence
  Description of Artificial Sequence: Synthetic oligonucleotide
  Target: SOD1; (-) strand; PAM type: YTN; PAM sequence: TTT
tgtggctaatcttaaggttg

SEQ ID NO: 13055 - DNA, 20 bp, Artificial Sequence
  Description of Artificial Sequence: Synthetic oligonucleotide
  Target: SOD1; (-) strand; PAM type: YTN; PAM sequence: CTA
ggtatcaaagcccagttttg

SEQ ID NO: 13056 - DNA, 20 bp, Artificial Sequence
  Description of Artificial Sequence: Synthetic oligonucleotide
  Target: SOD1; (-) strand; PAM type: YTN; PAM sequence: TTC
cacacctaggtatcaaagcc

SEQ ID NO: 13057 - DNA, 20 bp, Artificial Sequence
  Description of Artificial Sequence: Synthetic oligonucleotide
  Target: SOD1; (-) strand; PAM type: YTN; PAM sequence: TTT
ccacacctaggtatcaaagc

SEQ ID NO: 13058 - DNA, 20 bp, Artificial Sequence
  Description of Artificial Sequence: Synthetic oligonucleotide
  Target: SOD1; (-) strand; PAM type: YTN; PAM sequence: TTT
tccacacctaggtatcaaag

SEQ ID NO: 13059 - DNA, 20 bp, Artificial Sequence
  Description of Artificial Sequence: Synthetic oligonucleotide
  Target: SOD1; (-) strand; PAM type: YTN; PAM sequence: CTT
ttccacacctaggtatcaaa

SEQ ID NO: 13060 - DNA, 20 bp, Artificial Sequence
  Description of Artificial Sequence: Synthetic oligonucleotide
  Target: SOD1; (-) strand; PAM type: YTN; PAM sequence: TTC
ttttccacacctaggtatca

SEQ ID NO: 13061 - DNA, 20 bp, Artificial Sequence
  Description of Artificial Sequence: Synthetic oligonucleotide
  Target: SOD1; (-) strand; PAM type: YTN; PAM sequence: TTT
cttttccacacctaggtatc

SEQ ID NO: 13062 - DNA, 20 bp, Artificial Sequence
  Description of Artificial Sequence: Synthetic oligonucleotide
  Target: SOD1; (-) strand; PAM type: YTN; PAM sequence: CTT
tcttttccacacctaggtat

SEQ ID NO: 13063 - DNA, 20 bp, Artificial Sequence
  Description of Artificial Sequence: Synthetic oligonucleotide
  Target: SOD1; (-) strand; PAM type: YTN; PAM sequence: TTC
cctttcttttccacacctag

SEQ ID NO: 13064 - DNA, 20 bp, Artificial Sequence
  Description of Artificial Sequence: Synthetic oligonucleotide
  Target: SOD1; (-) strand; PAM type: YTN; PAM sequence: TTT
ccctttcttttccacaccta

SEQ ID NO: 13065 - DNA, 20 bp, Artificial Sequence
  Description of Artificial Sequence: Synthetic oligonucleotide
  Target: SOD1; (-) strand; PAM type: YTN; PAM sequence: CTT
tccctttcttttccacacct

SEQ ID NO: 13066 - DNA, 20 bp, Artificial Sequence
  Description of Artificial Sequence: Synthetic oligonucleotide
  Target: SOD1; (-) strand; PAM type: YTN; PAM sequence: CTC
tttccctttcttttccacac

SEQ ID NO: 13067 - DNA, 20 bp, Artificial Sequence
  Description of Artificial Sequence: Synthetic oligonucleotide
  Target: SOD1; (-) strand; PAM type: YTN; PAM sequence: CTG
taagacaaaacatcaactct

SEQ ID NO: 13068 - DNA, 20 bp, Artificial Sequence
  Description of Artificial Sequence: Synthetic oligonucleotide
  Target: SOD1; (-) strand; PAM type: YTN; PAM sequence: CTA
caatgatgctgtaagacaaa

SEQ ID NO: 13069 - DNA, 20 bp, Artificial Sequence
  Description of Artificial Sequence: Synthetic oligonucleotide
  Target: SOD1; (-) strand; PAM type: YTN; PAM sequence: TTC
tacaatgatgctgtaagaca

SEQ ID NO: 13070 - DNA, 20 bp, Artificial Sequence
  Description of Artificial Sequence: Synthetic oligonucleotide
  Target: SOD1; (-) strand; PAM type: YTN; PAM sequence: CTT
ctacaatgatgctgtaagac

SEQ ID NO: 13071 - DNA, 20 bp, Artificial Sequence
  Description of Artificial Sequence: Synthetic oligonucleotide
  Target: SOD1; (-) strand; PAM type: YTN; PAM sequence: CTC
ttctacaatgatgctgtaag

SEQ ID NO: 13072 - DNA, 20 bp, Artificial Sequence
  Description of Artificial Sequence: Synthetic oligonucleotide
  Target: SOD1; (-) strand; PAM type: YTN; PAM sequence: CTC
aaaaaacaaacaaacaaaaa

SEQ ID NO: 13073 - DNA, 20 bp, Artificial Sequence
  Description of Artificial Sequence: Synthetic oligonucleotide
  Target: SOD1; (-) strand; PAM type: YTN; PAM sequence: CTC
cgtctcaaaaaacaaacaaa

SEQ ID NO: 13074 - DNA, 20 bp, Artificial Sequence
  Description of Artificial Sequence: Synthetic oligonucleotide
  Target: SOD1; (-) strand; PAM type: YTN; PAM sequence: CTG
ggccacagagtaagactccg

SEQ ID NO: 13075 - DNA, 20 bp, Artificial Sequence
  Description of Artificial Sequence: Synthetic oligonucleotide
  Target: SOD1; (-) strand; PAM type: YTN; PAM sequence: CTC
cagcctgggccacagagtaa

SEQ ID NO: 13076 - DNA, 20 bp, Artificial Sequence
  Description of Artificial Sequence: Synthetic oligonucleotide
  Target: SOD1; (-) strand; PAM type: YTN; PAM sequence: CTG
cactccagcctgggccacag

SEQ ID NO: 13077 - DNA, 20 bp, Artificial Sequence
  Description of Artificial Sequence: Synthetic oligonucleotide
  Target: SOD1; (-) strand; PAM type: YTN; PAM sequence: TTG
cagtgagccgagatcgcgcc

SEQ ID NO: 13078 - DNA, 20 bp, Artificial Sequence
  Description of Artificial Sequence: Synthetic oligonucleotide
  Target: SOD1; (-) strand; PAM type: YTN; PAM sequence: CTT
gcagtgagccgagatcgcgc

SEQ ID NO: 13079 - DNA, 20 bp, Artificial Sequence
  Description of Artificial Sequence: Synthetic oligonucleotide
  Target: SOD1; (-) strand; PAM type: YTN; PAM sequence: CTG
aggcaggagaatggcatgaa

SEQ ID NO: 13080 - DNA, 20 bp, Artificial Sequence
  Description of Artificial Sequence: Synthetic oligonucleotide
  Target: SOD1; (-) strand; PAM type: YTN; PAM sequence: CTC
agggggctgaggcaggagaa

SEQ ID NO: 13081 - DNA, 20 bp, Artificial Sequence
  Description of Artificial Sequence: Synthetic oligonucleotide
  Target: SOD1; (-) strand; PAM type: YTN; PAM sequence: CTA
ctcagggggctgaggcagga

SEQ ID NO: 13082 - DNA, 20 bp, Artificial Sequence
  Description of Artificial Sequence: Synthetic oligonucleotide
  Target: SOD1; (-) strand; PAM type: YTN; PAM sequence: CTG
tagtcccagctactcagggg

SEQ ID NO: 13083 - DNA, 20 bp, Artificial Sequence
  Description of Artificial Sequence: Synthetic oligonucleotide
  Target: SOD1; (-) strand; PAM type: YTN; PAM sequence: TTA
gccaggcggggtggcgggca

SEQ ID NO: 13084 - DNA, 20 bp, Artificial Sequence
  Description of Artificial Sequence: Synthetic oligonucleotide
  Target: SOD1; (-) strand; PAM type: YTN; PAM sequence: CTA
aaaatacaaaaaattagcca

SEQ ID NO: 13085 - DNA, 20 bp, Artificial Sequence
  Description of Artificial Sequence: Synthetic oligonucleotide
  Target: SOD1; (-) strand; PAM type: YTN; PAM sequence: CTA
ctaaaaatacaaaaaattag

SEQ ID NO: 13086 - DNA, 20 bp, Artificial Sequence
  Description of Artificial Sequence: Synthetic oligonucleotide
  Target: SOD1; (-) strand; PAM type: YTN; PAM sequence: CTC
tactaaaaatacaaaaaatt

SEQ ID NO: 13087 - DNA, 20 bp, Artificial Sequence
  Description of Artificial Sequence: Synthetic oligonucleotide
  Target: SOD1; (-) strand; PAM type: YTN; PAM sequence: CTA
acacagtgaaaccccgtctc

SEQ ID NO: 13088 - DNA, 20 bp, Artificial Sequence
  Description of Artificial Sequence: Synthetic oligonucleotide
  Target: SOD1; (-) strand; PAM type: YTN; PAM sequence: TTG
gctaacacagtgaaaccccg

SEQ ID NO: 13089 - DNA, 20 bp, Artificial Sequence
  Description of Artificial Sequence: Synthetic oligonucleotide
  Target: SOD1; (-) strand; PAM type: YTN; PAM sequence: CTT
ggctaacacagtgaaacccc

SEQ ID NO: 13090 - DNA, 20 bp, Artificial Sequence
  Description of Artificial Sequence: Synthetic oligonucleotide
  Target: SOD1; (-) strand; PAM type: YTN; PAM sequence: CTG
agacaggcggatcacgaggt

SEQ ID NO: 13091 - DNA, 20 bp, Artificial Sequence
  Description of Artificial Sequence: Synthetic oligonucleotide
  Target: SOD1; (-) strand; PAM type: YTN; PAM sequence: TTG
ggaggctgagacaggcggat

SEQ ID NO: 13092 - DNA, 20 bp, Artificial Sequence
  Description of Artificial Sequence: Synthetic oligonucleotide
  Target: SOD1; (-) strand; PAM type: YTN; PAM sequence: TTT
gggaggctgagacaggcgga

SEQ ID NO: 13093 - DNA, 20 bp, Artificial Sequence
  Description of Artificial Sequence: Synthetic oligonucleotide
  Target: SOD1; (-) strand; PAM type: YTN; PAM sequence: CTT
tgggaggctgagacaggcgg

SEQ ID NO: 13094 - DNA, 20 bp, Artificial Sequence
  Description of Artificial Sequence: Synthetic oligonucleotide
  Target: SOD1; (-) strand; PAM type: YTN; PAM sequence: CTG
taatcccagcactttgggag

SEQ ID NO: 13095 - DNA, 20 bp, Artificial Sequence
  Description of Artificial Sequence: Synthetic oligonucleotide
  Target: SOD1; (-) strand; PAM type: YTN; PAM sequence: CTC
atgcctgtaatcccagcact

SEQ ID NO: 13096 - DNA, 20 bp, Artificial Sequence
  Description of Artificial Sequence: Synthetic oligonucleotide
  Target: SOD1; (-) strand; PAM type: YTN; PAM sequence: CTG
ggtgcggtggctcatgcctg

SEQ ID NO: 13097 - DNA, 20 bp, Artificial Sequence
  Description of Artificial Sequence: Synthetic oligonucleotide
  Target: SOD1; (-) strand; PAM type: YTN; PAM sequence: CTG
gctgggtgcggtggctcatg

SEQ ID NO: 13098 - DNA, 20 bp, Artificial Sequence
  Description of Artificial Sequence: Synthetic oligonucleotide
  Target: SOD1; (-) strand; PAM type: YTN; PAM sequence: TTC
tggctgggtgcggtggctca

SEQ ID NO: 13099 - DNA, 20 bp, Artificial Sequence
  Description of Artificial Sequence: Synthetic oligonucleotide
  Target: SOD1; (-) strand; PAM type: YTN; PAM sequence: CTT
ctggctgggtgcggtggctc

SEQ ID NO: 13100 - DNA, 20 bp, Artificial Sequence
  Description of Artificial Sequence: Synthetic oligonucleotide
  Target: SOD1; (-) strand; PAM type: YTN; PAM sequence: CTC
ttctggctgggtgcggtggc

SEQ ID NO: 13101 - DNA, 20 bp, Artificial Sequence
  Description of Artificial Sequence: Synthetic oligonucleotide
  Target: SOD1; (-) strand; PAM type: YTN; PAM sequence: TTA
aaaaacaccctcttctggct

SEQ ID NO: 13102 - DNA, 20 bp, Artificial Sequence
  Description of Artificial Sequence: Synthetic oligonucleotide
  Target: SOD1; (-) strand; PAM type: YTN; PAM sequence: TTT
aaaaaacaccctcttctggc

SEQ ID NO: 13103 - DNA, 20 bp, Artificial Sequence
  Description of Artificial Sequence: Synthetic oligonucleotide
  Target: SOD1; (-) strand; PAM type: YTN; PAM sequence: CTT
taaaaaacaccctcttctgg

SEQ ID NO: 13104 - DNA, 20 bp, Artificial Sequence
  Description of Artificial Sequence: Synthetic oligonucleotide
  Target: SOD1; (-) strand; PAM type: YTN; PAM sequence: TTC
tttaaaaaacaccctcttct

SEQ ID NO: 13105 - DNA, 20 bp, Artificial Sequence
  Description of Artificial Sequence: Synthetic oligonucleotide
  Target: SOD1; (-) strand; PAM type: YTN; PAM sequence: CTT
ctttaaaaaacaccctcttc

SEQ ID NO: 13106 - DNA, 20 bp, Artificial Sequence
  Description of Artificial Sequence: Synthetic oligonucleotide
  Target: SOD1; (-) strand; PAM type: YTN; PAM sequence: TTG
ccttctttaaaaaacaccct

SEQ ID NO: 13107 - DNA, 20 bp, Artificial Sequence
  Description of Artificial Sequence: Synthetic oligonucleotide
  Target: SOD1; (-) strand; PAM type: YTN; PAM sequence: TTT
gccttctttaaaaaacaccc

SEQ ID NO: 13108 - DNA, 20 bp, Artificial Sequence
  Description of Artificial Sequence: Synthetic oligonucleotide
  Target: SOD1; (-) strand; PAM type: YTN; PAM sequence: CTA
tttgccttctttaaaaaaca

SEQ ID NO: 13109 - DNA, 20 bp, Artificial Sequence
  Description of Artificial Sequence: Synthetic oligonucleotide
  Target: SOD1; (-) strand; PAM type: YTN; PAM sequence: TTC
ctatttgccttctttaaaaa

SEQ ID NO: 13110 - DNA, 20 bp, Artificial Sequence
  Description of Artificial Sequence: Synthetic oligonucleotide
  Target: SOD1; (-) strand; PAM type: YTN; PAM sequence: TTT
cctatttgccttctttaaaa

SEQ ID NO: 13111 - DNA, 20 bp, Artificial Sequence
  Description of Artificial Sequence: Synthetic oligonucleotide
  Target: SOD1; (-) strand; PAM type: YTN; PAM sequence: TTA
tttcctatttgccttcttta

SEQ ID NO: 13112 - DNA, 20 bp, Artificial Sequence
  Description of Artificial Sequence: Synthetic oligonucleotide
  Target: SOD1; (-) strand; PAM type: YTN; PAM sequence: TTT
atttcctatttgccttcttt

SEQ ID NO: 13113 - DNA, 20 bp, Artificial Sequence
  Description of Artificial Sequence: Synthetic oligonucleotide
  Target: SOD1; (-) strand; PAM type: YTN; PAM sequence: TTT
tatttcctatttgccttctt

SEQ ID NO: 13114 - DNA, 20 bp, Artificial Sequence
  Description of Artificial Sequence: Synthetic oligonucleotide
  Target: SOD1; (-) strand; PAM type: YTN; PAM sequence: TTT
ttatttcctatttgccttct

SEQ ID NO: 13115 - DNA, 20 bp, Artificial Sequence
  Description of Artificial Sequence: Synthetic oligonucleotide
  Target: SOD1; (-) strand; PAM type: YTN; PAM sequence: TTA
agagcccaagtttttatttc

SEQ ID NO: 13116 - DNA, 20 bp, Artificial Sequence
  Description of Artificial Sequence: Synthetic oligonucleotide
  Target: SOD1; (-) strand; PAM type: YTN; PAM sequence: TTA
caaaagttaagagcccaagt

SEQ ID NO: 13117 - DNA, 20 bp, Artificial Sequence
  Description of Artificial Sequence: Synthetic oligonucleotide
  Target: SOD1; (-) strand; PAM type: YTN; PAM sequence: CTG
ggatcattacaaaagttaag

SEQ ID NO: 13118 - DNA, 20 bp, Artificial Sequence
  Description of Artificial Sequence: Synthetic oligonucleotide
  Target: SOD1; (-) strand; PAM type: YTN; PAM sequence: CTC
aaacacctgggatcattaca

SEQ ID NO: 13119 - DNA, 20 bp, Artificial Sequence
  Description of Artificial Sequence: Synthetic oligonucleotide
  Target: SOD1; (-) strand; PAM type: YTN; PAM sequence: CTC
aacccccagctcaaacacct

SEQ ID NO: 13120 - DNA, 20 bp, Artificial Sequence
  Description of Artificial Sequence: Synthetic oligonucleotide
  Target: SOD1; (-) strand; PAM type: YTN; PAM sequence: CTC
gaggcacccaccctcaaccc

SEQ ID NO: 13121 - DNA, 20 bp, Artificial Sequence
  Description of Artificial Sequence: Synthetic oligonucleotide
  Target: SOD1; (-) strand; PAM type: YTN; PAM sequence: TTG
ctcgaggcacccaccctcaa

SEQ ID NO: 13122 - DNA, 20 bp, Artificial Sequence
  Description of Artificial Sequence: Synthetic oligonucleotide
  Target: SOD1; (-) strand; PAM type: YTN; PAM sequence: TTT
gctcgaggcacccaccctca

SEQ ID NO: 13123 - DNA, 20 bp, Artificial Sequence
  Description of Artificial Sequence: Synthetic oligonucleotide
  Target: SOD1; (-) strand; PAM type: YTN; PAM sequence: CTT
tgctcgaggcacccaccctc

SEQ ID NO: 13124 - DNA, 20 bp, Artificial Sequence
  Description of Artificial Sequence: Synthetic oligonucleotide
  Target: SOD1; (-) strand; PAM type: YTN; PAM sequence: TTA
tgcaaataaatgcagcccct

SEQ ID NO: 13125 - DNA, 20 bp, Artificial Sequence
  Description of Artificial Sequence: Synthetic oligonucleotide
  Target: SOD1; (-) strand; PAM type: YTN; PAM sequence: TTA
catggcattatgcaaataaa

SEQ ID NO: 13126 - DNA, 20 bp, Artificial Sequence
  Description of Artificial Sequence: Synthetic oligonucleotide
  Target: SOD1; (-) strand; PAM type: YTN; PAM sequence: CTT
acatggcattatgcaaataa

SEQ ID NO: 13127 - DNA, 20 bp, Artificial Sequence
  Description of Artificial Sequence: Synthetic oligonucleotide
  Target: SOD1; (-) strand; PAM type: YTN; PAM sequence: CTC
ttacatggcattatgcaaat

SEQ ID NO: 13128 - DNA, 20 bp, Artificial Sequence
  Description of Artificial Sequence: Synthetic oligonucleotide
  Target: SOD1; (-) strand; PAM type: YTN; PAM sequence: CTA
ctcttacatggcattatgca

SEQ ID NO: 13129 - DNA, 20 bp, Artificial Sequence
  Description of Artificial Sequence: Synthetic oligonucleotide
  Target: SOD1; (-) strand; PAM type: YTN; PAM sequence: TTG
gggtgtagagctactcttac

SEQ ID NO: 13130 - DNA, 20 bp, Artificial Sequence
  Description of Artificial Sequence: Synthetic oligonucleotide
  Target: SOD1; (-) strand; PAM type: YTN; PAM sequence: TTT
ggggtgtagagctactctta

SEQ ID NO: 13131 - DNA, 20 bp, Artificial Sequence
  Description of Artificial Sequence: Synthetic oligonucleotide
  Target: SOD1; (-) strand; PAM type: YTN; PAM sequence: CTG
tgtttggggtgtagagctac

SEQ ID NO: 13132 - DNA, 20 bp, Artificial Sequence
  Description of Artificial Sequence: Synthetic oligonucleotide
  Target: SOD1; (-) strand; PAM type: YTN; PAM sequence: CTA
agaagcctgtgtttggggtg

SEQ ID NO: 13133 - DNA, 20 bp, Artificial Sequence
  Description of Artificial Sequence: Synthetic oligonucleotide
  Target: SOD1; (-) strand; PAM type: YTN; PAM sequence: TTG
gtcccactaagaagcctgtg

SEQ ID NO: 13134 - DNA, 20 bp, Artificial Sequence
  Description of Artificial Sequence: Synthetic oligonucleotide
  Target: SOD1; (-) strand; PAM type: YTN; PAM sequence: TTT
ggtcccactaagaagcctgt

SEQ ID NO: 13135 - DNA, 20 bp, Artificial Sequence
  Description of Artificial Sequence: Synthetic oligonucleotide
  Target: SOD1; (-) strand; PAM type: YTN; PAM sequence: CTT
tggtcccactaagaagcctg

SEQ ID NO: 13136 - DNA, 20 bp, Artificial Sequence
  Description of Artificial Sequence: Synthetic oligonucleotide
  Target: SOD1; (-) strand; PAM type: YTN; PAM sequence: TTG
tatcatactttggtcccact

SEQ ID NO: 13137 - DNA, 20 bp, Artificial Sequence
  Description of Artificial Sequence: Synthetic oligonucleotide
  Target: SOD1; (-) strand; PAM type: YTN; PAM sequence: TTT
gtatcatactttggtcccac

SEQ ID NO: 13138 - DNA, 20 bp, Artificial Sequence
  Description of Artificial Sequence: Synthetic oligonucleotide
  Target: SOD1; (-) strand; PAM type: YTN; PAM sequence: TTC
agtttgtatcatactttggt

SEQ ID NO: 13139 - DNA, 20 bp, Artificial Sequence
  Description of Artificial Sequence: Synthetic oligonucleotide
  Target: SOD1; (-) strand; PAM type: YTN; PAM sequence: CTT
cagtttgtatcatactttgg

SEQ ID NO: 13140 - DNA, 20 bp, Artificial Sequence
  Description of Artificial Sequence: Synthetic oligonucleotide
  Target: SOD1; (-) strand; PAM type: YTN; PAM sequence: TTC
catcttcagtttgtatcata

SEQ ID NO: 13141 - DNA, 20 bp, Artificial Sequence
  Description of Artificial Sequence: Synthetic oligonucleotide
  Target: SOD1; (-) strand; PAM type: YTN; PAM sequence: CTG
cattccatcttcagtttgta

SEQ ID NO: 13142 - DNA, 20 bp, Artificial Sequence
  Description of Artificial Sequence: Synthetic oligonucleotide
  Target: SOD1; (-) strand; PAM type: YTN; PAM sequence: CTC
tgcattccatcttcagtttg

SEQ ID NO: 13143 - DNA, 20 bp, Artificial Sequence
  Description of Artificial Sequence: Synthetic oligonucleotide
  Target: SOD1; (-) strand; PAM type: YTN; PAM sequence: TTC
caaagtaccaataatcctct

SEQ ID NO: 13144 - DNA, 20 bp, Artificial Sequence
  Description of Artificial Sequence: Synthetic oligonucleotide
  Target: SOD1; (-) strand; PAM type: YTN; PAM sequence: TTA
agcatattccaaagtaccaa

SEQ ID NO: 13145 - DNA, 20 bp, Artificial Sequence
  Description of Artificial Sequence: Synthetic oligonucleotide
  Target: SOD1; (-) strand; PAM type: YTN; PAM sequence: TTT
aagcatattccaaagtacca

SEQ ID NO: 13146 - DNA, 20 bp, Artificial Sequence
  Description of Artificial Sequence: Synthetic oligonucleotide
  Target: SOD1; (-) strand; PAM type: YTN; PAM sequence: TTT
taagcatattccaaagtacc

SEQ ID NO: 13147 - DNA, 20 bp, Artificial Sequence
  Description of Artificial Sequence: Synthetic oligonucleotide
  Target: SOD1; (-) strand; PAM type: YTN; PAM sequence: TTT
ttaagcatattccaaagtac

SEQ ID NO: 13148 - DNA, 20 bp, Artificial Sequence
  Description of Artificial Sequence: Synthetic oligonucleotide
  Target: SOD1; (-) strand; PAM type: YTN; PAM sequence: TTT
tttaagcatattccaaagta

SEQ ID NO: 13149 - DNA, 20 bp, Artificial Sequence
  Description of Artificial Sequence: Synthetic oligonucleotide
  Target: SOD1; (-) strand; PAM type: YTN; PAM sequence: TTT
ttttaagcatattccaaagt

SEQ ID NO: 13150 - DNA, 20 bp, Artificial Sequence
  Description of Artificial Sequence: Synthetic oligonucleotide
  Target: SOD1; (-) strand; PAM type: YTN; PAM sequence: TTT
tttttaagcatattccaaag

SEQ ID NO: 13151 - DNA, 20 bp, Artificial Sequence
  Description of Artificial Sequence: Synthetic oligonucleotide
  Target: SOD1; (-) strand; PAM type: YTN; PAM sequence: TTA
aaaaaattttttttaagcat

SEQ ID NO: 13152 - DNA, 20 bp, Artificial Sequence
  Description of Artificial Sequence: Synthetic oligonucleotide
  Target: SOD1; (-) strand; PAM type: YTN; PAM sequence: TTT
aaaaaaattttttttaagca

SEQ ID NO: 13153 - DNA, 20 bp, Artificial Sequence
  Description of Artificial Sequence: Synthetic oligonucleotide
  Target: SOD1; (-) strand; PAM type: YTN; PAM sequence: CTT
taaaaaaattttttttaagc

SEQ ID NO: 13154 - DNA, 20 bp, Artificial Sequence
  Description of Artificial Sequence: Synthetic oligonucleotide
  Target: SOD1; (-) strand; PAM type: YTN; PAM sequence: TTA
aaaatactttaaaaaaattt

SEQ ID NO: 13155 - DNA, 20 bp, Artificial Sequence
  Description of Artificial Sequence: Synthetic oligonucleotide
  Target: SOD1; (-) strand; PAM type: YTN; PAM sequence: TTT
aaaaatactttaaaaaaatt

SEQ ID NO: 13156 - DNA, 20 bp, Artificial Sequence
  Description of Artificial Sequence: Synthetic oligonucleotide
  Target: SOD1; (-) strand; PAM type: YTN; PAM sequence: TTT
taaaaatactttaaaaaaat

SEQ ID NO: 13157 - DNA, 20 bp, Artificial Sequence
  Description of Artificial Sequence: Synthetic oligonucleotide
  Target: SOD1; (-) strand; PAM type: YTN; PAM sequence: TTT
ttaaaaatactttaaaaaaa

SEQ ID NO: 13158 - DNA, 20 bp, Artificial Sequence
  Description of Artificial Sequence: Synthetic oligonucleotide
  Target: SOD1; (-) strand; PAM type: YTN; PAM sequence: TTT
tttaaaaatactttaaaaaa

SEQ ID NO: 13159 - DNA, 20 bp, Artificial Sequence
  Description of Artificial Sequence: Synthetic oligonucleotide
  Target: SOD1; (-) strand; PAM type: YTN; PAM sequence: CTG
attttttaaaaatactttaa

SEQ ID NO: 13160 - DNA, 20 bp, Artificial Sequence
  Description of Artificial Sequence: Synthetic oligonucleotide
  Target: SOD1; (-) strand; PAM type: YTN; PAM sequence: TTG
cctgattttttaaaaatact

SEQ ID NO: 13161 - DNA, 20 bp, Artificial Sequence
  Description of Artificial Sequence: Synthetic oligonucleotide
  Target: SOD1; (-) strand; PAM type: YTN; PAM sequence: TTC
aggggttgcctgatttttta

SEQ ID NO: 13162 - DNA, 20 bp, Artificial Sequence
  Description of Artificial Sequence: Synthetic oligonucleotide
  Target: SOD1; (-) strand; PAM type: YTN; PAM sequence: CTG
gttcaggggttgcctgattt

SEQ ID NO: 13163 - DNA, 20 bp, Artificial Sequence
  Description of Artificial Sequence: Synthetic oligonucleotide
  Target: SOD1; (-) strand; PAM type: YTN; PAM sequence: CTC
tggttcaggggttgcctgat

SEQ ID NO: 13164 - DNA, 20 bp, Artificial Sequence
  Description of Artificial Sequence: Synthetic oligonucleotide
  Target: SOD1; (-) strand; PAM type: YTN; PAM sequence: CTA
ctctggttcaggggttgcct

SEQ ID NO: 13165 - DNA, 20 bp, Artificial Sequence
  Description of Artificial Sequence: Synthetic oligonucleotide
  Target: SOD1; (-) strand; PAM type: YTN; PAM sequence: CTG
aacctactctggttcagggg

SEQ ID NO: 13166 - DNA, 20 bp, Artificial Sequence
  Description of Artificial Sequence: Synthetic oligonucleotide
  Target: SOD1; (-) strand; PAM type: YTN; PAM sequence: CTC
tgaacctactctggttcagg

SEQ ID NO: 13167 - DNA, 20 bp, Artificial Sequence
  Description of Artificial Sequence: Synthetic oligonucleotide
  Target: SOD1; (-) strand; PAM type: YTN; PAM sequence: TTC
tctgaacctactctggttca

SEQ ID NO: 13168 - DNA, 20 bp, Artificial Sequence
  Description of Artificial Sequence: Synthetic oligonucleotide
  Target: SOD1; (-) strand; PAM type: YTN; PAM sequence: TTT
ctctgaacctactctggttc

SEQ ID NO: 13169 - DNA, 20 bp, Artificial Sequence
  Description of Artificial Sequence: Synthetic oligonucleotide
  Target: SOD1; (-) strand; PAM type: YTN; PAM sequence: TTG
gcagtttctctgaacctact

SEQ ID NO: 13170 - DNA, 20 bp, Artificial Sequence
  Description of Artificial Sequence: Synthetic oligonucleotide
  Target: SOD1; (-) strand; PAM type: YTN; PAM sequence: TTT
ggcagtttctctgaacctac

SEQ ID NO: 13171 - DNA, 20 bp, Artificial Sequence
  Description of Artificial Sequence: Synthetic oligonucleotide
  Target: SOD1; (-) strand; PAM type: YTN; PAM sequence: TTA
agaaaataaaatttggcagt

SEQ ID NO: 13172 - DNA, 20 bp, Artificial Sequence
  Description of Artificial Sequence: Synthetic oligonucleotide
  Target: SOD1; (-) strand; PAM type: YTN; PAM sequence: TTC
caatcccaaattaagaaaat

SEQ ID NO: 13173 - DNA, 20 bp, Artificial Sequence
  Description of Artificial Sequence: Synthetic oligonucleotide
  Target: SOD1; (-) strand; PAM type: YTN; PAM sequence: CTT
ccaatcccaaattaagaaaa

SEQ ID NO: 13174 - DNA, 20 bp, Artificial Sequence
  Description of Artificial Sequence: Synthetic oligonucleotide
  Target: SOD1; (-) strand; PAM type: YTN; PAM sequence: TTG
cttccaatcccaaattaaga

SEQ ID NO: 13175 - DNA, 20 bp, Artificial Sequence
  Description of Artificial Sequence: Synthetic oligonucleotide
  Target: SOD1; (-) strand; PAM type: YTN; PAM sequence: CTT
gcttccaatcccaaattaag

SEQ ID NO: 13176 - DNA, 20 bp, Artificial Sequence
  Description of Artificial Sequence: Synthetic oligonucleotide
  Target: SOD1; (-) strand; PAM type: YTN; PAM sequence: TTA
acttgcttccaatcccaaat

SEQ ID NO: 13177 - DNA, 20 bp, Artificial Sequence
  Description of Artificial Sequence: Synthetic oligonucleotide
  Target: SOD1; (-) strand; PAM type: YTN; PAM sequence: CTG
ttaacttgcttccaatccca

SEQ ID NO: 13178 - DNA, 20 bp, Artificial Sequence
  Description of Artificial Sequence: Synthetic oligonucleotide
  Target: SOD1; (-) strand; PAM type: YTN; PAM sequence: TTC
tgttaacttgcttccaatcc

SEQ ID NO: 13179 - DNA, 20 bp, Artificial Sequence
  Description of Artificial Sequence: Synthetic oligonucleotide
  Target: SOD1; (-) strand; PAM type: YTN; PAM sequence: CTT
ctgttaacttgcttccaatc

SEQ ID NO: 13180 - DNA, 20 bp, Artificial Sequence
  Description of Artificial Sequence: Synthetic oligonucleotide
  Target: SOD1; (-) strand; PAM type: YTN; PAM sequence: CTC
ataaacttctgttaacttgc

SEQ ID NO: 13181 - DNA, 20 bp, Artificial Sequence
  Description of Artificial Sequence: Synthetic oligonucleotide
  Target: SOD1; (-) strand; PAM type: YTN; PAM sequence: TTA
actcataaacttctgttaac

SEQ ID NO: 13182 - DNA, 20 bp, Artificial Sequence
  Description of Artificial Sequence: Synthetic oligonucleotide
  Target: SOD1; (-) strand; PAM type: YTN; PAM sequence: CTT
aactcataaacttctgttaa

SEQ ID NO: 13183 - DNA, 20 bp, Artificial Sequence
  Description of Artificial Sequence: Synthetic oligonucleotide
  Target: SOD1; (-) strand; PAM type: YTN; PAM sequence: CTA
aatgcaacttaactcataaa

SEQ ID NO: 13184 - DNA, 20 bp, Artificial Sequence
  Description of Artificial Sequence: Synthetic oligonucleotide
  Target: SOD1; (-) strand; PAM type: YTN; PAM sequence: CTC
aaatatggcaaaagatcact

SEQ ID NO: 13185 - DNA, 20 bp, Artificial Sequence
  Description of Artificial Sequence: Synthetic oligonucleotide
  Target: SOD1; (-) strand; PAM type: YTN; PAM sequence: TTA
ctcaaatatggcaaaagatc

SEQ ID NO: 13186 - DNA, 20 bp, Artificial Sequence
  Description of Artificial Sequence: Synthetic oligonucleotide
  Target: SOD1; (-) strand; PAM type: YTN; PAM sequence: TTA
ttactcaaatatggcaaaag

SEQ ID NO: 13187 - DNA, 20 bp, Artificial Sequence
  Description of Artificial Sequence: Synthetic oligonucleotide
  Target: SOD1; (-) strand; PAM type: YTN; PAM sequence: CTA
taaacaaaaaaatcagatta

SEQ ID NO: 13188 - DNA, 20 bp, Artificial Sequence
  Description of Artificial Sequence: Synthetic oligonucleotide
  Target: SOD1; (-) strand; PAM type: YTN; PAM sequence: TTA
agaagaaatctataaacaaa

SEQ ID NO: 13189 - DNA, 20 bp, Artificial Sequence
  Description of Artificial Sequence: Synthetic oligonucleotide
  Target: SOD1; (-) strand; PAM type: YTN; PAM sequence: TTT
aagaagaaatctataaacaa

SEQ ID NO: 13190 - DNA, 20 bp, Artificial Sequence
  Description of Artificial Sequence: Synthetic oligonucleotide
  Target: SOD1; (-) strand; PAM type: YTN; PAM sequence: TTA
atttaagaagaaatctataa

SEQ ID NO: 13191 - DNA, 20 bp, Artificial Sequence
  Description of Artificial Sequence: Synthetic oligonucleotide
  Target: SOD1; (-) strand; PAM type: YTN; PAM sequence: TTA
gcaagatgaataaagttaat

SEQ ID NO: 13192 - DNA, 20 bp, Artificial Sequence
  Description of Artificial Sequence: Synthetic oligonucleotide
  Target: SOD1; (-) strand; PAM type: YTN; PAM sequence: CTA
aattagcaagatgaataaag

SEQ ID NO: 13193 - DNA, 20 bp, Artificial Sequence
  Description of Artificial Sequence: Synthetic oligonucleotide
  Target: SOD1; (-) strand; PAM type: YTN; PAM sequence: TTG
aaactaaattagcaagatga

SEQ ID NO: 13194 - DNA, 20 bp, Artificial Sequence
  Description of Artificial Sequence: Synthetic oligonucleotide
  Target: SOD1; (-) strand; PAM type: YTN; PAM sequence: TTT
gaaactaaattagcaagatg

SEQ ID NO: 13195 - DNA, 20 bp, Artificial Sequence
  Description of Artificial Sequence: Synthetic oligonucleotide
  Target: SOD1; (-) strand; PAM type: YTN; PAM sequence: CTA
tttgaaactaaattagcaag

SEQ ID NO: 13196 - DNA, 20 bp, Artificial Sequence
  Description of Artificial Sequence: Synthetic oligonucleotide
  Target: SOD1; (-) strand; PAM type: YTN; PAM sequence: TTA
caaatcactatttgaaacta

SEQ ID NO: 13197 - DNA, 20 bp, Artificial Sequence
  Description of Artificial Sequence: Synthetic oligonucleotide
  Target: SOD1; (-) strand; PAM type: YTN; PAM sequence: CTG
atcattacaaatcactattt

SEQ ID NO: 13198 - DNA, 20 bp, Artificial Sequence
  Description of Artificial Sequence: Synthetic oligonucleotide
  Target: SOD1; (-) strand; PAM type: YTN; PAM sequence: TTA
cagaaatggatcaaatctga

SEQ ID NO: 13199 - DNA, 20 bp, Artificial Sequence
  Description of Artificial Sequence: Synthetic oligonucleotide
  Target: SOD1; (-) strand; PAM type: YTN; PAM sequence: TTC
agcaattacagaaatggatc

SEQ ID NO: 13200 - DNA, 20 bp, Artificial Sequence
  Description of Artificial Sequence: Synthetic oligonucleotide
  Target: SOD1; (-) strand; PAM type: YTN; PAM sequence: TTT
cagcaattacagaaatggat

SEQ ID NO: 13201 - DNA, 20 bp, Artificial Sequence
  Description of Artificial Sequence: Synthetic oligonucleotide
  Target: SOD1; (-) strand; PAM type: YTN; PAM sequence: CTC
gggggaatttcagcaattac

SEQ ID NO: 13202 - DNA, 20 bp, Artificial Sequence
  Description of Artificial Sequence: Synthetic oligonucleotide
  Target: SOD1; (-) strand; PAM type: YTN; PAM sequence: CTC
ccagaccagaggcggtaaag

SEQ ID NO: 13203 - DNA, 20 bp, Artificial Sequence
  Description of Artificial Sequence: Synthetic oligonucleotide
  Target: SOD1; (-) strand; PAM type: YTN; PAM sequence: TTA
caggaagcagcagagcaatc

SEQ ID NO: 13204 - DNA, 20 bp, Artificial Sequence
  Description of Artificial Sequence: Synthetic oligonucleotide
  Target: SOD1; (-) strand; PAM type: YTN; PAM sequence: CTC
acccgcaggagtcccacaca

SEQ ID NO: 13205 - DNA, 20 bp, Artificial Sequence
  Description of Artificial Sequence: Synthetic oligonucleotide
  Target: SOD1; (-) strand; PAM type: YTN; PAM sequence: CTC
tcacccgcaggagtcccaca

SEQ ID NO: 13206 - DNA, 20 bp, Artificial Sequence
  Description of Artificial Sequence: Synthetic oligonucleotide
  Target: SOD1; (-) strand; PAM type: YTN; PAM sequence: TTC
agccacgctctcacccgcag

SEQ ID NO: 13207 - DNA, 20 bp, Artificial Sequence
  Description of Artificial Sequence: Synthetic oligonucleotide
  Target: SOD1; (-) strand; PAM type: YTN; PAM sequence: CTT
cagccacgctctcacccgca

SEQ ID NO: 13208 - DNA, 20 bp, Artificial Sequence
  Description of Artificial Sequence: Synthetic oligonucleotide
  Target: SOD1; (-) strand; PAM type: YTN; PAM sequence: CTG
tcttcagccacgctctcacc

SEQ ID NO: 13209 - DNA, 20 bp, Artificial Sequence
  Description of Artificial Sequence: Synthetic oligonucleotide
  Target: SOD1; (-) strand; PAM type: YTN; PAM sequence: TTC
ataacacggctgtcttcagc

SEQ ID NO: 13210 - DNA, 20 bp, Artificial Sequence
  Description of Artificial Sequence: Synthetic oligonucleotide
  Target: SOD1; (-) strand; PAM type: YTN; PAM sequence: TTT
cataacacggctgtcttcag

SEQ ID NO: 13211 - DNA, 20 bp, Artificial Sequence
  Description of Artificial Sequence: Synthetic oligonucleotide
  Target: SOD1; (-) strand; PAM type: YTN; PAM sequence: CTT
tcataacacggctgtcttca

SEQ ID NO: 13212 - DNA, 20 bp, Artificial Sequence
  Description of Artificial Sequence: Synthetic oligonucleotide
  Target: SOD1; (-) strand; PAM type: YTN; PAM sequence: CTC
gacagcacaggaggcccttt

SEQ ID NO: 13213 - DNA, 20 bp, Artificial Sequence
  Description of Artificial Sequence: Synthetic oligonucleotide
  Target: SOD1; (-) strand; PAM type: YTN; PAM sequence: TTC
acagagcacaacctcgacag

SEQ ID NO: 13214 - DNA, 20 bp, Artificial Sequence
  Description of Artificial Sequence: Synthetic oligonucleotide
  Target: SOD1; (-) strand; PAM type: YTN; PAM sequence: CTG
tgcaccaggggatgacattc

SEQ ID NO: 13215 - DNA, 20 bp, Artificial Sequence
  Description of Artificial Sequence: Synthetic oligonucleotide
  Target: SOD1; (-) strand; PAM type: YTN; PAM sequence: CTG
ctgtgcaccaggggatgaca

SEQ ID NO: 13216 - DNA, 20 bp, Artificial Sequence
  Description of Artificial Sequence: Synthetic oligonucleotide
  Target: SOD1; (-) strand; PAM type: YTN; PAM sequence: CTG
tgtagaaggtgctgctgtgc

SEQ ID NO: 13217 - DNA, 20 bp, Artificial Sequence
  Description of Artificial Sequence: Synthetic oligonucleotide
  Target: SOD1; (-) strand; PAM type: YTN; PAM sequence: CTG
tatcctgtgtagaaggtgct

SEQ ID NO: 13218 - DNA, 20 bp, Artificial Sequence
  Description of Artificial Sequence: Synthetic oligonucleotide
  Target: SOD1; (-) strand; PAM type: YTN; PAM sequence: TTC
caactgtatcctgtgtagaa

SEQ ID NO: 13219 - DNA, 20 bp, Artificial Sequence
  Description of Artificial Sequence: Synthetic oligonucleotide
  Target: SOD1; (-) strand; PAM type: YTN; PAM sequence: CTC
gagggggcggcattccaact

SEQ ID NO: 13220 - DNA, 20 bp, Artificial Sequence
  Description of Artificial Sequence: Synthetic oligonucleotide
  Target: SOD1; (-) strand; PAM type: YTN; PAM sequence: TTA
cacaactcgagggggcggca

SEQ ID NO: 13221 - DNA, 20 bp, Artificial Sequence
  Description of Artificial Sequence: Synthetic oligonucleotide
  Target: SOD1; (-) strand; PAM type: YTN; PAM sequence: CTT
acacaactcgagggggcggc

SEQ ID NO: 13222 - DNA, 20 bp, Artificial Sequence
  Description of Artificial Sequence: Synthetic oligonucleotide
  Target: SOD1; (-) strand; PAM type: YTN; PAM sequence: CTG
ccttacacaactcgaggggg

SEQ ID NO: 13223 - DNA, 20 bp, Artificial Sequence
  Description of Artificial Sequence: Synthetic oligonucleotide
  Target: SOD1; (-) strand; PAM type: YTN; PAM sequence: CTG
ctgccttacacaactcgagg

SEQ ID NO: 13224 - DNA, 20 bp, Artificial Sequence
  Description of Artificial Sequence: Synthetic oligonucleotide
  Target: SOD1; (-) strand; PAM type: YTN; PAM sequence: TTA
tgtgcaagggccaaggctgc

SEQ ID NO: 13225 - DNA, 20 bp, Artificial Sequence
  Description of Artificial Sequence: Synthetic oligonucleotide
  Target: SOD1; (-) strand; PAM type: YTN; PAM sequence: CTT
atgtgcaagggccaaggctg

SEQ ID NO: 13226 - DNA, 20 bp, Artificial Sequence
  Description of Artificial Sequence: Synthetic oligonucleotide
  Target: SOD1; (-) strand; PAM type: YTN; PAM sequence: TTC
aacagcatcttatgtgcaag

SEQ ID NO: 13227 - DNA, 20 bp, Artificial Sequence
  Description of Artificial Sequence: Synthetic oligonucleotide
  Target: SOD1; (-) strand; PAM type: YTN; PAM sequence: TTG
gtgcaggcagaatattcaac

SEQ ID NO: 13228 - DNA, 20 bp, Artificial Sequence
  Description of Artificial Sequence: Synthetic oligonucleotide
  Target: SOD1; (-) strand; PAM type: YTN; PAM sequence: CTT
ggtgcaggcagaatattcaa

SEQ ID NO: 13229 - DNA, 20 bp, Artificial Sequence
  Description of Artificial Sequence: Synthetic oligonucleotide
  Target: SOD1; (-) strand; PAM type: YTN; PAM sequence: TTA
cttggtgcaggcagaatatt

SEQ ID NO: 13230 - DNA, 20 bp, Artificial Sequence
  Description of Artificial Sequence: Synthetic oligonucleotide
  Target: SOD1; (-) strand; PAM type: YTN; PAM sequence: TTT
acttggtgcaggcagaatat

SEQ ID NO: 13231 - DNA, 20 bp, Artificial Sequence
  Description of Artificial Sequence: Synthetic oligonucleotide
  Target: SOD1; (-) strand; PAM type: YTN; PAM sequence: CTT
tacttggtgcaggcagaata

SEQ ID NO: 13232 - DNA, 20 bp, Artificial Sequence
  Description of Artificial Sequence: Synthetic oligonucleotide
  Target: SOD1; (-) strand; PAM type: YTN; PAM sequence: CTG
tgccctttacttggtgcagg

SEQ ID NO: 13233 - DNA, 20 bp, Artificial Sequence
  Description of Artificial Sequence: Synthetic oligonucleotide
  Target: SOD1; (-) strand; PAM type: YTN; PAM sequence: CTA
tctgtgccctttacttggtg

SEQ ID NO: 13234 - DNA, 20 bp, Artificial Sequence
  Description of Artificial Sequence: Synthetic oligonucleotide
  Target: SOD1; (-) strand; PAM type: YTN; PAM sequence: TTC
tatctgtgccctttacttgg

SEQ ID NO: 13235 - DNA, 20 bp, Artificial Sequence
  Description of Artificial Sequence: Synthetic oligonucleotide
  Target: SOD1; (-) strand; PAM type: YTN; PAM sequence: CTC
cccagcaacatatgccaagc

SEQ ID NO: 13236 - DNA, 20 bp, Artificial Sequence
  Description of Artificial Sequence: Synthetic oligonucleotide
  Target: SOD1; (-) strand; PAM type: YTN; PAM sequence: CTC
atctccccagcaacatatgc

SEQ ID NO: 13237 - DNA, 20 bp, Artificial Sequence
  Description of Artificial Sequence: Synthetic oligonucleotide
  Target: SOD1; (-) strand; PAM type: YTN; PAM sequence: TTA
caaaaaactcatctccccag

SEQ ID NO: 13238 - DNA, 20 bp, Artificial Sequence
  Description of Artificial Sequence: Synthetic oligonucleotide
  Target: SOD1; (-) strand; PAM type: YTN; PAM sequence: TTT
acaaaaaactcatctcccca

SEQ ID NO: 13239 - DNA, 20 bp, Artificial Sequence
  Description of Artificial Sequence: Synthetic oligonucleotide
  Target: SOD1; (-) strand; PAM type: YTN; PAM sequence: CTT
tacaaaaaactcatctcccc

SEQ ID NO: 13240 - DNA, 20 bp, Artificial Sequence
  Description of Artificial Sequence: Synthetic oligonucleotide
  Target: SOD1; (-) strand; PAM type: YTN; PAM sequence: TTA
agaacgtagtatactttaca

SEQ ID NO: 13241 - DNA, 20 bp, Artificial Sequence
  Description of Artificial Sequence: Synthetic oligonucleotide
  Target: SOD1; (-) strand; PAM type: YTN; PAM sequence: CTT
aagaacgtagtatactttac

SEQ ID NO: 13242 - DNA, 20 bp, Artificial Sequence
  Description of Artificial Sequence: Synthetic oligonucleotide
  Target: SOD1; (-) strand; PAM type: YTN; PAM sequence: TTC
ttaagaacgtagtatacttt

SEQ ID NO: 13243 - DNA, 20 bp, Artificial Sequence
  Description of Artificial Sequence: Synthetic oligonucleotide
  Target: SOD1; (-) strand; PAM type: YTN; PAM sequence: TTA
tgatccaaattcttaagaac

SEQ ID NO: 13244 - DNA, 20 bp, Artificial Sequence
  Description of Artificial Sequence: Synthetic oligonucleotide
  Target: SOD1; (-) strand; PAM type: YTN; PAM sequence: TTA
aaatcccatggttatgatcc

SEQ ID NO: 13245 - DNA, 20 bp, Artificial Sequence
  Description of Artificial Sequence: Synthetic oligonucleotide
  Target: SOD1; (-) strand; PAM type: YTN; PAM sequence: TTA
ttaaaatcccatggttatga

SEQ ID NO: 13246 - DNA, 20 bp, Artificial Sequence
  Description of Artificial Sequence: Synthetic oligonucleotide
  Target: SOD1; (-) strand; PAM type: YTN; PAM sequence: CTA
ttattaaaatcccatggtta

SEQ ID NO: 13247 - DNA, 20 bp, Artificial Sequence
  Description of Artificial Sequence: Synthetic oligonucleotide
  Target: SOD1; (-) strand; PAM type: YTN; PAM sequence: TTC
tattattaaaatcccatggt

SEQ ID NO: 13248 - DNA, 20 bp, Artificial Sequence
  Description of Artificial Sequence: Synthetic oligonucleotide
  Target: SOD1; (-) strand; PAM type: YTN; PAM sequence: TTT
ctattattaaaatcccatgg

SEQ ID NO: 13249 - DNA, 20 bp, Artificial Sequence
  Description of Artificial Sequence: Synthetic oligonucleotide
  Target: SOD1; (-) strand; PAM type: YTN; PAM sequence: TTT
tctattattaaaatcccatg

SEQ ID NO: 13250 - DNA, 20 bp, Artificial Sequence
  Description of Artificial Sequence: Synthetic oligonucleotide
  Target: SOD1; (-) strand; PAM type: YTN; PAM sequence: TTT
ttctattattaaaatcccat

SEQ ID NO: 13251 - DNA, 20 bp, Artificial Sequence
  Description of Artificial Sequence: Synthetic oligonucleotide
  Target: SOD1; (-) strand; PAM type: YTN; PAM sequence: TTC
aacagtttttctattattaa

SEQ ID NO: 13252 - DNA, 20 bp, Artificial Sequence
  Description of Artificial Sequence: Synthetic oligonucleotide
  Target: SOD1; (-) strand; PAM type: YTN; PAM sequence: CTT
caacagtttttctattatta

SEQ ID NO: 13253 - DNA, 20 bp, Artificial Sequence
  Description of Artificial Sequence: Synthetic oligonucleotide
  Target: SOD1; (-) strand; PAM type: YTN; PAM sequence: CTG
atcttcaacagtttttctat

SEQ ID NO: 13254 - DNA, 20 bp, Artificial Sequence
  Description of Artificial Sequence: Synthetic oligonucleotide
  Target: SOD1; (-) strand; PAM type: YTN; PAM sequence: CTG
taaaaataagggaccagact

SEQ ID NO: 13255 - DNA, 20 bp, Artificial Sequence
  Description of Artificial Sequence: Synthetic oligonucleotide
  Target: SOD1; (-) strand; PAM type: YTN; PAM sequence: TTC
actgtaaaaataagggacca

SEQ ID NO: 13256 - DNA, 20 bp, Artificial Sequence
  Description of Artificial Sequence: Synthetic oligonucleotide
  Target: SOD1; (-) strand; PAM type: YTN; PAM sequence: CTT
cactgtaaaaataagggacc

SEQ ID NO: 13257 - DNA, 20 bp, Artificial Sequence
  Description of Artificial Sequence: Synthetic oligonucleotide
  Target: SOD1; (-) strand; PAM type: YTN; PAM sequence: TTC
ttcactgtaaaaataaggga

SEQ ID NO: 13258 - DNA, 20 bp, Artificial Sequence
  Description of Artificial Sequence: Synthetic oligonucleotide
  Target: SOD1; (-) strand; PAM type: YTN; PAM sequence: CTT
cttcactgtaaaaataaggg

SEQ ID NO: 13259 - DNA, 20 bp, Artificial Sequence
  Description of Artificial Sequence: Synthetic oligonucleotide
  Target: SOD1; (-) strand; PAM type: YTN; PAM sequence: TTG
gcttcttcactgtaaaaata

SEQ ID NO: 13260 - DNA, 20 bp, Artificial Sequence
  Description of Artificial Sequence: Synthetic oligonucleotide
  Target: SOD1; (-) strand; PAM type: YTN; PAM sequence: TTT
ggcttcttcactgtaaaaat

SEQ ID NO: 13261 - DNA, 20 bp, Artificial Sequence
  Description of Artificial Sequence: Synthetic oligonucleotide
  Target: SOD1; (-) strand; PAM type: YTN; PAM sequence: CTT
tggcttcttcactgtaaaaa

SEQ ID NO: 13262 - DNA, 20 bp, Artificial Sequence
  Description of Artificial Sequence: Synthetic oligonucleotide
  Target: SOD1; (-) strand; PAM type: YTN; PAM sequence: CTG
ggctttggcttcttcactgt

SEQ ID NO: 13263 - DNA, 20 bp, Artificial Sequence
  Description of Artificial Sequence: Synthetic oligonucleotide
  Target: SOD1; (-) strand; PAM type: YTN; PAM sequence: CTC
tgggctttggcttcttcact

SEQ ID NO: 13264 - DNA, 20 bp, Artificial Sequence
  Description of Artificial Sequence: Synthetic oligonucleotide
  Target: SOD1; (-) strand; PAM type: YTN; PAM sequence: TTC
tctgggctttggcttcttca

SEQ ID NO: 13265 - DNA, 20 bp, Artificial Sequence
  Description of Artificial Sequence: Synthetic oligonucleotide
  Target: SOD1; (-) strand; PAM type: YTN; PAM sequence: CTT
ctctgggctttggcttcttc

SEQ ID NO: 13266 - DNA, 20 bp, Artificial Sequence
  Description of Artificial Sequence: Synthetic oligonucleotide
  Target: SOD1; (-) strand; PAM type: YTN; PAM sequence: TTA
acacccttctctgggctttg

SEQ ID NO: 13267 - DNA, 20 bp, Artificial Sequence
  Description of Artificial Sequence: Synthetic oligonucleotide
  Target: SOD1; (-) strand; PAM type: YTN; PAM sequence: TTG
taaagttaacacccttctct

SEQ ID NO: 13268 - DNA, 20 bp, Artificial Sequence
  Description of Artificial Sequence: Synthetic oligonucleotide
  Target: SOD1; (-) strand; PAM type: YTN; PAM sequence: CTT
gtaaagttaacacccttctc

SEQ ID NO: 13269 - DNA, 20 bp, Artificial Sequence
  Description of Artificial Sequence: Synthetic oligonucleotide
  Target: SOD1; (-) strand; PAM type: YTN; PAM sequence: CTG
acacttgtaaagttaacacc

SEQ ID NO: 13270 - DNA, 20 bp, Artificial Sequence
  Description of Artificial Sequence: Synthetic oligonucleotide
  Target: SOD1; (-) strand; PAM type: YTN; PAM sequence: CTG
tctgacacttgtaaagttaa

SEQ ID NO: 13271 - DNA, 20 bp, Artificial Sequence
  Description of Artificial Sequence: Synthetic oligonucleotide
  Target: SOD1; (-) strand; PAM type: YTN; PAM sequence: CTA
ctgtctgacacttgtaaagt

SEQ ID NO: 13272 - DNA, 20 bp, Artificial Sequence
  Description of Artificial Sequence: Synthetic oligonucleotide
  Target: SOD1; (-) strand; PAM type: YTN; PAM sequence: CTA
actactgtctgacacttgta

SEQ ID NO: 13273 - DNA, 20 bp, Artificial Sequence
  Description of Artificial Sequence: Synthetic oligonucleotide
  Target: SOD1; (-) strand; PAM type: YTN; PAM sequence: TTC
taactactgtctgacacttg

SEQ ID NO: 13274 - DNA, 20 bp, Artificial Sequence
  Description of Artificial Sequence: Synthetic oligonucleotide
  Target: SOD1; (-) strand; PAM type: YTN; PAM sequence: CTC
aaaaaaaaaaaaaaaaaaac

SEQ ID NO: 13275 - DNA, 20 bp, Artificial Sequence
  Description of Artificial Sequence: Synthetic oligonucleotide
  Target: SOD1; (-) strand; PAM type: YTN; PAM sequence: CTC
catctcaaaaaaaaaaaaaa

SEQ ID NO: 13276 - DNA, 20 bp, Artificial Sequence
  Description of Artificial Sequence: Synthetic oligonucleotide
  Target: SOD1; (-) strand; PAM type: YTN; PAM sequence: CTG
ggcaacagagcaagactcca

SEQ ID NO: 13277 - DNA, 20 bp, Artificial Sequence
  Description of Artificial Sequence: Synthetic oligonucleotide
  Target: SOD1; (-) strand; PAM type: YTN; PAM sequence: CTC
cagcctgggcaacagagcaa

SEQ ID NO: 13278 - DNA, 20 bp, Artificial Sequence
  Description of Artificial Sequence: Synthetic oligonucleotide
  Target: SOD1; (-) strand; PAM type: YTN; PAM sequence: CTG
cactccagcctgggcaacag

SEQ ID NO: 13279 - DNA, 20 bp, Artificial Sequence
  Description of Artificial Sequence: Synthetic oligonucleotide
  Target: SOD1; (-) strand; PAM type: YTN; PAM sequence: CTG
agatcgcaccactgcactcc

SEQ ID NO: 13280 - DNA, 20 bp, Artificial Sequence
  Description of Artificial Sequence: Synthetic oligonucleotide
  Target: SOD1; (-) strand; PAM type: YTN; PAM sequence: TTG
cagtgagctgagatcgcacc

SEQ ID NO: 13281 - DNA, 20 bp, Artificial Sequence
  Description of Artificial Sequence: Synthetic oligonucleotide
  Target: SOD1; (-) strand; PAM type: YTN; PAM sequence: CTG
ggaggcagaggttgcagtga

SEQ ID NO: 13282 - DNA, 20 bp, Artificial Sequence
  Description of Artificial Sequence: Synthetic oligonucleotide
  Target: SOD1; (-) strand; PAM type: YTN; PAM sequence: TTG
aacctgggaggcagaggttg

SEQ ID NO: 13283 - DNA, 20 bp, Artificial Sequence
  Description of Artificial Sequence: Synthetic oligonucleotide
  Target: SOD1; (-) strand; PAM type: YTN; PAM sequence: CTT
gaacctgggaggcagaggtt

SEQ ID NO: 13284 - DNA, 20 bp, Artificial Sequence
  Description of Artificial Sequence: Synthetic oligonucleotide
  Target: SOD1; (-) strand; PAM type: YTN; PAM sequence: CTG
aggcaggagaatcgcttgaa

SEQ ID NO: 13285 - DNA, 20 bp, Artificial Sequence
  Description of Artificial Sequence: Synthetic oligonucleotide
  Target: SOD1; (-) strand; PAM type: YTN; PAM sequence: TTA
gtaggctgaggcaggagaat

SEQ ID NO: 13286 - DNA, 20 bp, Artificial Sequence
  Description of Artificial Sequence: Synthetic oligonucleotide
  Target: SOD1; (-) strand; PAM type: YTN; PAM sequence: CTT
agtaggctgaggcaggagaa

SEQ ID NO: 13287 - DNA, 20 bp, Artificial Sequence
  Description of Artificial Sequence: Synthetic oligonucleotide
  Target: SOD1; (-) strand; PAM type: YTN; PAM sequence: CTA
cttagtaggctgaggcagga

SEQ ID NO: 13288 - DNA, 20 bp, Artificial Sequence
  Description of Artificial Sequence: Synthetic oligonucleotide
  Target: SOD1; (-) strand; PAM type: YTN; PAM sequence: CTA
tagtcccagctacttagtag

SEQ ID NO: 13289 - DNA, 20 bp, Artificial Sequence
  Description of Artificial Sequence: Synthetic oligonucleotide
  Target: SOD1; (-) strand; PAM type: YTN; PAM sequence: CTA
ggcgtggtggtgcgcaccta

SEQ ID NO: 13290 - DNA, 20 bp, Artificial Sequence
  Description of Artificial Sequence: Synthetic oligonucleotide
  Target: SOD1; (-) strand; PAM type: YTN; PAM sequence: TTA
gctaggcgtggtggtgcgca

SEQ ID NO: 13291 - DNA, 20 bp, Artificial Sequence
  Description of Artificial Sequence: Synthetic oligonucleotide
  Target: SOD1; (-) strand; PAM type: YTN; PAM sequence: CTG
aaaaaatacaaaaattagct

SEQ ID NO: 13292 - DNA, 20 bp, Artificial Sequence
  Description of Artificial Sequence: Synthetic oligonucleotide
  Target: SOD1; (-) strand; PAM type: YTN; PAM sequence: CTA
ctgaaaaaatacaaaaatta

SEQ ID NO: 13293 - DNA, 20 bp, Artificial Sequence
  Description of Artificial Sequence: Synthetic oligonucleotide
  Target: SOD1; (-) strand; PAM type: YTN; PAM sequence: CTC
tactgaaaaaatacaaaaat

SEQ ID NO: 13294 - DNA, 20 bp, Artificial Sequence
  Description of Artificial Sequence: Synthetic oligonucleotide
  Target: SOD1; (-) strand; PAM type: YTN; PAM sequence: CTG
tctctactgaaaaaatacaa

SEQ ID NO: 13295 - DNA, 20 bp, Artificial Sequence
  Description of Artificial Sequence: Synthetic oligonucleotide
  Target: SOD1; (-) strand; PAM type: YTN; PAM sequence: CTG
gccagcatagcaaaaccctg

SEQ ID NO: 13296 - DNA, 20 bp, Artificial Sequence
  Description of Artificial Sequence: Synthetic oligonucleotide
  Target: SOD1; (-) strand; PAM type: YTN; PAM sequence: TTG
agaccagcctggccagcata

SEQ ID NO: 13297 - DNA, 20 bp, Artificial Sequence
  Description of Artificial Sequence: Synthetic oligonucleotide
  Target: SOD1; (-) strand; PAM type: YTN; PAM sequence: TTT
gagaccagcctggccagcat

SEQ ID NO: 13298 - DNA, 20 bp, Artificial Sequence
  Description of Artificial Sequence: Synthetic oligonucleotide
  Target: SOD1; (-) strand; PAM type: YTN; PAM sequence: CTG
aggtcaggagtttgagacca

SEQ ID NO: 13299 - DNA, 20 bp, Artificial Sequence
  Description of Artificial Sequence: Synthetic oligonucleotide
  Target: SOD1; (-) strand; PAM type: YTN; PAM sequence: CTG
gatcatctgaggtcaggagt

SEQ ID NO: 13300 - DNA, 20 bp, Artificial Sequence
  Description of Artificial Sequence: Synthetic oligonucleotide
  Target: SOD1; (-) strand; PAM type: YTN; PAM sequence: CTG
aggtggctggatcatctgag

SEQ ID NO: 13301 - DNA, 20 bp, Artificial Sequence
  Description of Artificial Sequence: Synthetic oligonucleotide
  Target: SOD1; (-) strand; PAM type: YTN; PAM sequence: TTG
ggaagctgaggtggctggat

SEQ ID NO: 13302 - DNA, 20 bp, Artificial Sequence
  Description of Artificial Sequence: Synthetic oligonucleotide
  Target: SOD1; (-) strand; PAM type: YTN; PAM sequence: TTT
gggaagctgaggtggctgga

SEQ ID NO: 13303 - DNA, 20 bp, Artificial Sequence
  Description of Artificial Sequence: Synthetic oligonucleotide
  Target: SOD1; (-) strand; PAM type: YTN; PAM sequence: CTT
tgggaagctgaggtggctgg

SEQ ID NO: 13304 - DNA, 20 bp, Artificial Sequence
  Description of Artificial Sequence: Synthetic oligonucleotide
  Target: SOD1; (-) strand; PAM type: YTN; PAM sequence: CTG
gaaccccagcactttgggaa

SEQ ID NO: 13305 - DNA, 20 bp, Artificial Sequence
  Description of Artificial Sequence: Synthetic oligonucleotide
  Target: SOD1; (-) strand; PAM type: YTN; PAM sequence: CTA
acacctggaaccccagcact

SEQ ID NO: 13306 - DNA, 20 bp, Artificial Sequence
  Description of Artificial Sequence: Synthetic oligonucleotide
  Target: SOD1; (-) strand; PAM type: YTN; PAM sequence: CTA
tggccaggcatggtggctaa

SEQ ID NO: 13307 - DNA, 20 bp, Artificial Sequence
  Description of Artificial Sequence: Synthetic oligonucleotide
  Target: SOD1; (-) strand; PAM type: YTN; PAM sequence: TTG
gtacagccacagtgagaagg

SEQ ID NO: 13308 - DNA, 20 bp, Artificial Sequence
  Description of Artificial Sequence: Synthetic oligonucleotide
  Target: SOD1; (-) strand; PAM type: YTN; PAM sequence: CTT
ggtacagccacagtgagaag

SEQ ID NO: 13309 - DNA, 20 bp, Artificial Sequence
  Description of Artificial Sequence: Synthetic oligonucleotide
  Target: SOD1; (-) strand; PAM type: YTN; PAM sequence: CTG
ggataagcaacaccttggta

SEQ ID NO: 13310 - DNA, 20 bp, Artificial Sequence
  Description of Artificial Sequence: Synthetic oligonucleotide
  Target: SOD1; (-) strand; PAM type: YTN; PAM sequence: TTC
tgggataagcaacaccttgg

SEQ ID NO: 13311 - DNA, 20 bp, Artificial Sequence
  Description of Artificial Sequence: Synthetic oligonucleotide
  Target: SOD1; (-) strand; PAM type: YTN; PAM sequence: CTT
ctgggataagcaacaccttg

SEQ ID NO: 13312 - DNA, 20 bp, Artificial Sequence
  Description of Artificial Sequence: Synthetic oligonucleotide
  Target: SOD1; (-) strand; PAM type: YTN; PAM sequence: CTG
catcacgacttctgggataa

SEQ ID NO: 13313 - DNA, 20 bp, Artificial Sequence
  Description of Artificial Sequence: Synthetic oligonucleotide
  Target: SOD1; (-) strand; PAM type: YTN; PAM sequence: CTG
acctgcatcacgacttctgg

SEQ ID NO: 13314 - DNA, 20 bp, Artificial Sequence
  Description of Artificial Sequence: Synthetic oligonucleotide
  Target: SOD1; (-) strand; PAM type: YTN; PAM sequence: TTC
ccatggagaaagtgctgacc

SEQ ID NO: 13315 - DNA, 20 bp, Artificial Sequence
  Description of Artificial Sequence: Synthetic oligonucleotide
  Target: SOD1; (-) strand; PAM type: YTN; PAM sequence: CTT
cccatggagaaagtgctgac

SEQ ID NO: 13316 - DNA, 20 bp, Artificial Sequence
  Description of Artificial Sequence: Synthetic oligonucleotide
  Target: SOD1; (-) strand; PAM type: YTN; PAM sequence: CTA
aaacttcccatggagaaagt

SEQ ID NO: 13317 - DNA, 20 bp, Artificial Sequence
  Description of Artificial Sequence: Synthetic oligonucleotide
  Target: SOD1; (-) strand; PAM type: YTN; PAM sequence: CTG
ctaaaacttcccatggagaa

SEQ ID NO: 13318 - DNA, 20 bp, Artificial Sequence
  Description of Artificial Sequence: Synthetic oligonucleotide
  Target: SOD1; (-) strand; PAM type: YTN; PAM sequence: CTA
aaaagaaacactgctaaaac

SEQ ID NO: 13319 - DNA, 20 bp, Artificial Sequence
  Description of Artificial Sequence: Synthetic oligonucleotide
  Target: SOD1; (-) strand; PAM type: YTN; PAM sequence: TTC
taaaaagaaacactgctaaa

SEQ ID NO: 13320 - DNA, 20 bp, Artificial Sequence
  Description of Artificial Sequence: Synthetic oligonucleotide
  Target: SOD1; (-) strand; PAM type: YTN; PAM sequence: TTC
ccaaatacattctaaaaaga

SEQ ID NO: 13321 - DNA, 20 bp, Artificial Sequence
  Description of Artificial Sequence: Synthetic oligonucleotide
  Target: SOD1; (-) strand; PAM type: YTN; PAM sequence: TTA
aagttcccaaatacattcta

SEQ ID NO: 13322 - DNA, 20 bp, Artificial Sequence
  Description of Artificial Sequence: Synthetic oligonucleotide
  Target: SOD1; (-) strand; PAM type: YTN; PAM sequence: TTA
tgaattaaagttcccaaata

SEQ ID NO: 13323 - DNA, 20 bp, Artificial Sequence
  Description of Artificial Sequence: Synthetic oligonucleotide
  Target: SOD1; (-) strand; PAM type: YTN; PAM sequence: CTA
aattatgaattaaagttccc

SEQ ID NO: 13324 - DNA, 20 bp, Artificial Sequence
  Description of Artificial Sequence: Synthetic oligonucleotide
  Target: SOD1; (-) strand; PAM type: YTN; PAM sequence: TTA
taagaagaagaaaaaaaagc

SEQ ID NO: 13325 - DNA, 20 bp, Artificial Sequence
  Description of Artificial Sequence: Synthetic oligonucleotide
  Target: SOD1; (-) strand; PAM type: YTN; PAM sequence: TTT
ataagaagaagaaaaaaaag

SEQ ID NO: 13326 - DNA, 20 bp, Artificial Sequence
  Description of Artificial Sequence: Synthetic oligonucleotide
  Target: SOD1; (-) strand; PAM type: YTN; PAM sequence: CTA
tttataagaagaagaaaaaa

SEQ ID NO: 13327 - DNA, 20 bp, Artificial Sequence
  Description of Artificial Sequence: Synthetic oligonucleotide
  Target: SOD1; (-) strand; PAM type: YTN; PAM sequence: CTG
gtacagcctatttataagaa

SEQ ID NO: 13328 - DNA, 20 bp, Artificial Sequence
  Description of Artificial Sequence: Synthetic oligonucleotide
  Target: SOD1; (-) strand; PAM type: YTN; PAM sequence: CTG
cactggtacagcctatttat

SEQ ID NO: 13329 - DNA, 20 bp, Artificial Sequence
  Description of Artificial Sequence: Synthetic oligonucleotide
  Target: SOD1; (-) strand; PAM type: YTN; PAM sequence: TTA
aagtgaggacctgcactggt

SEQ ID NO: 13330 - DNA, 20 bp, Artificial Sequence
  Description of Artificial Sequence: Synthetic oligonucleotide
  Target: SOD1; (-) strand; PAM type: YTN; PAM sequence: CTG
gatagaggattaaagtgagg

SEQ ID NO: 13331 - DNA, 20 bp, Artificial Sequence
  Description of Artificial Sequence: Synthetic oligonucleotide
  Target: SOD1; (-) strand; PAM type: YTN; PAM sequence: TTC
tggatagaggattaaagtga

SEQ ID NO: 13332 - DNA, 20 bp, Artificial Sequence
  Description of Artificial Sequence: Synthetic oligonucleotide
  Target: SOD1; (-) strand; PAM type: YTN; PAM sequence: TTT
ctggatagaggattaaagtg

SEQ ID NO: 13333 - DNA, 20 bp, Artificial Sequence
  Description of Artificial Sequence: Synthetic oligonucleotide
  Target: SOD1; (-) strand; PAM type: YTN; PAM sequence: TTT
tctggatagaggattaaagt

SEQ ID NO: 13334 - DNA, 20 bp, Artificial Sequence
  Description of Artificial Sequence: Synthetic oligonucleotide
  Target: SOD1; (-) strand; PAM type: YTN; PAM sequence: TTG
gcccaccgtgttttctggat

SEQ ID NO: 13335 - DNA, 20 bp, Artificial Sequence
  Description of Artificial Sequence: Synthetic oligonucleotide
  Target: SOD1; (-) strand; PAM type: YTN; PAM sequence: TTT
ggcccaccgtgttttctgga

SEQ ID NO: 13336 - DNA, 20 bp, Artificial Sequence
  Description of Artificial Sequence: Synthetic oligonucleotide
  Target: SOD1; (-) strand; PAM type: YTN; PAM sequence: CTT
tggcccaccgtgttttctgg

SEQ ID NO: 13337 - DNA, 20 bp, Artificial Sequence
  Description of Artificial Sequence: Synthetic oligonucleotide
  Target: SOD1; (-) strand; PAM type: YTN; PAM sequence: TTC
atcctttggcccaccgtgtt

SEQ ID NO: 13338 - DNA, 20 bp, Artificial Sequence
  Description of Artificial Sequence: Synthetic oligonucleotide
  Target: SOD1; (-) strand; PAM type: YTN; PAM sequence: CTT
catcctttggcccaccgtgt

SEQ ID NO: 13339 - DNA, 20 bp, Artificial Sequence
  Description of Artificial Sequence: Synthetic oligonucleotide
  Target: SOD1; (-) strand; PAM type: YTN; PAM sequence: CTC
ttcatcctttggcccaccgt

SEQ ID NO: 13340 - DNA, 20 bp, Artificial Sequence
  Description of Artificial Sequence: Synthetic oligonucleotide
  Target: SOD1; (-) strand; PAM type: YTN; PAM sequence: CTC
tcttcatcctttggcccacc

SEQ ID NO: 13341 - DNA, 20 bp, Artificial Sequence
  Description of Artificial Sequence: Synthetic oligonucleotide
  Target: SOD1; (-) strand; PAM type: YTN; PAM sequence: TTA
cctctcttcatcctttggcc

SEQ ID NO: 13342 - DNA, 20 bp, Artificial Sequence
  Description of Artificial Sequence: Synthetic oligonucleotide
  Target: SOD1; (-) strand; PAM type: YTN; PAM sequence: TTG
ttacctctcttcatcctttg

SEQ ID NO: 13343 - DNA, 20 bp, Artificial Sequence
  Description of Artificial Sequence: Synthetic oligonucleotide
  Target: SOD1; (-) strand; PAM type: YTN; PAM sequence: CTT
gttacctctcttcatccttt

SEQ ID NO: 13344 - DNA, 20 bp, Artificial Sequence
  Description of Artificial Sequence: Synthetic oligonucleotide
  Target: SOD1; (-) strand; PAM type: YTN; PAM sequence: TTA
agcatcttgttacctctctt

SEQ ID NO: 13345 - DNA, 20 bp, Artificial Sequence
  Description of Artificial Sequence: Synthetic oligonucleotide
  Target: SOD1; (-) strand; PAM type: YTN; PAM sequence: TTA
caagagttaagcatcttgtt

SEQ ID NO: 13346 - DNA, 20 bp, Artificial Sequence
  Description of Artificial Sequence: Synthetic oligonucleotide
  Target: SOD1; (-) strand; PAM type: YTN; PAM sequence: TTA
ttacaagagttaagcatctt

SEQ ID NO: 13347 - DNA, 20 bp, Artificial Sequence
  Description of Artificial Sequence: Synthetic oligonucleotide
  Target: SOD1; (-) strand; PAM type: YTN; PAM sequence: CTA
tcgccattattacaagagtt

SEQ ID NO: 13348 - DNA, 20 bp, Artificial Sequence
  Description of Artificial Sequence: Synthetic oligonucleotide
  Target: SOD1; (-) strand; PAM type: YTN; PAM sequence: CTC
cagaaagctatcgccattat

SEQ ID NO: 13349 - DNA, 20 bp, Artificial Sequence
  Description of Artificial Sequence: Synthetic oligonucleotide
  Target: SOD1; (-) strand; PAM type: YTN; PAM sequence: TTA
caagtagtataccatatgaa

SEQ ID NO: 13350 - DNA, 20 bp, Artificial Sequence
  Description of Artificial Sequence: Synthetic oligonucleotide
  Target: SOD1; (-) strand; PAM type: YTN; PAM sequence: TTT
acaagtagtataccatatga

SEQ ID NO: 13351 - DNA, 20 bp, Artificial Sequence
  Description of Artificial Sequence: Synthetic oligonucleotide
  Target: SOD1; (-) strand; PAM type: YTN; PAM sequence: TTA
gcacatatttacaagtagta

SEQ ID NO: 13352 - DNA, 20 bp, Artificial Sequence
  Description of Artificial Sequence: Synthetic oligonucleotide
  Target: SOD1; (-) strand; PAM type: YTN; PAM sequence: CTT
agcacatatttacaagtagt

SEQ ID NO: 13353 - DNA, 20 bp, Artificial Sequence
  Description of Artificial Sequence: Synthetic oligonucleotide
  Target: SOD1; (-) strand; PAM type: YTN; PAM sequence: TTA
tcttagcacatatttacaag

SEQ ID NO: 13354 - DNA, 20 bp, Artificial Sequence
  Description of Artificial Sequence: Synthetic oligonucleotide
  Target: SOD1; (-) strand; PAM type: YTN; PAM sequence: TTC
aaaagcaaaggtgggggaaa

SEQ ID NO: 13355 - DNA, 20 bp, Artificial Sequence
  Description of Artificial Sequence: Synthetic oligonucleotide
  Target: SOD1; (-) strand; PAM type: YTN; PAM sequence: TTA
gatgagtcagcaagttcaaa

SEQ ID NO: 13356 - DNA, 20 bp, Artificial Sequence
  Description of Artificial Sequence: Synthetic oligonucleotide
  Target: SOD1; (-) strand; PAM type: YTN; PAM sequence: TTT
agatgagtcagcaagttcaa

SEQ ID NO: 13357 - DNA, 20 bp, Artificial Sequence
  Description of Artificial Sequence: Synthetic oligonucleotide
  Target: SOD1; (-) strand; PAM type: YTN; PAM sequence: TTG
ggagcaggggtttagatgag

SEQ ID NO: 13358 - DNA, 20 bp, Artificial Sequence
  Description of Artificial Sequence: Synthetic oligonucleotide
  Target: SOD1; (-) strand; PAM type: YTN; PAM sequence: TTT
gggagcaggggtttagatga

SEQ ID NO: 13359 - DNA, 20 bp, Artificial Sequence
  Description of Artificial Sequence: Synthetic oligonucleotide
  Target: SOD1; (-) strand; PAM type: YTN; PAM sequence: TTC
cagcatttgggagcaggggt

SEQ ID NO: 13360 - DNA, 20 bp, Artificial Sequence
  Description of Artificial Sequence: Synthetic oligonucleotide
  Target: SOD1; (-) strand; PAM type: YTN; PAM sequence: TTA
agcccaggaagtaaaagcat

SEQ ID NO: 13361 - DNA, 20 bp, Artificial Sequence
  Description of Artificial Sequence: Synthetic oligonucleotide
  Target: SOD1; (-) strand; PAM type: YTN; PAM sequence: TTT
aagcccaggaagtaaaagca

SEQ ID NO: 13362 - DNA, 20 bp, Artificial Sequence
  Description of Artificial Sequence: Synthetic oligonucleotide
  Target: SOD1; (-) strand; PAM type: YTN; PAM sequence: CTT
taagcccaggaagtaaaagc

SEQ ID NO: 13363 - DNA, 20 bp, Artificial Sequence
  Description of Artificial Sequence: Synthetic oligonucleotide
  Target: SOD1; (-) strand; PAM type: YTN; PAM sequence: TTC
ctttaagcccaggaagtaaa

SEQ ID NO: 13364 - DNA, 20 bp, Artificial Sequence
  Description of Artificial Sequence: Synthetic oligonucleotide
  Target: SOD1; (-) strand; PAM type: YTN; PAM sequence: TTG
tcaattcctttaagcccagg

SEQ ID NO: 13365 - DNA, 20 bp, Artificial Sequence
  Description of Artificial Sequence: Synthetic oligonucleotide
  Target: SOD1; (-) strand; PAM type: YTN; PAM sequence: TTT
gtcaattcctttaagcccag

SEQ ID NO: 13366 - DNA, 20 bp, Artificial Sequence
  Description of Artificial Sequence: Synthetic oligonucleotide
  Target: SOD1; (-) strand; PAM type: YTN; PAM sequence: TTA
agtgtccccatttgtcaatt

SEQ ID NO: 13367 - DNA, 20 bp, Artificial Sequence
  Description of Artificial Sequence: Synthetic oligonucleotide
  Target: SOD1; (-) strand; PAM type: YTN; PAM sequence: TTT
aagtgtccccatttgtcaat

SEQ ID NO: 13368 - DNA, 20 bp, Artificial Sequence
  Description of Artificial Sequence: Synthetic oligonucleotide
  Target: SOD1; (-) strand; PAM type: YTN; PAM sequence: TTT
taagtgtccccatttgtcaa

SEQ ID NO: 13369 - DNA, 20 bp, Artificial Sequence
  Description of Artificial Sequence: Synthetic oligonucleotide
  Target: SOD1; (-) strand; PAM type: YTN; PAM sequence: CTA
caaaaccaaatcgttttaag

SEQ ID NO: 13370 - DNA, 20 bp, Artificial Sequence
  Description of Artificial Sequence: Synthetic oligonucleotide
  Target: SOD1; (-) strand; PAM type: YTN; PAM sequence: TTC
aataaatgctacaaaaccaa

SEQ ID NO: 13371 - DNA, 20 bp, Artificial Sequence
  Description of Artificial Sequence: Synthetic oligonucleotide
  Target: SOD1; (-) strand; PAM type: YTN; PAM sequence: CTA
tattcaataaatgctacaaa

SEQ ID NO: 13372 - DNA, 20 bp, Artificial Sequence
  Description of Artificial Sequence: Synthetic oligonucleotide
  Target: SOD1; (-) strand; PAM type: YTN; PAM sequence: TTC
tatattcaataaatgctaca

SEQ ID NO: 13373 - DNA, 20 bp, Artificial Sequence
  Description of Artificial Sequence: Synthetic oligonucleotide
  Target: SOD1; (-) strand; PAM type: YTN; PAM sequence: TTA
gttctatattcaataaatgc

SEQ ID NO: 13374 - DNA, 20 bp, Artificial Sequence
  Description of Artificial Sequence: Synthetic oligonucleotide
  Target: SOD1; (-) strand; PAM type: YTN; PAM sequence: TTG
tattagttctatattcaata

SEQ ID NO: 13375 - DNA, 20 bp, Artificial Sequence
  Description of Artificial Sequence: Synthetic oligonucleotide
  Target: SOD1; (-) strand; PAM type: YTN; PAM sequence: CTT
gtattagttctatattcaat

SEQ ID NO: 13376 - DNA, 20 bp, Artificial Sequence
  Description of Artificial Sequence: Synthetic oligonucleotide
  Target: SOD1; (-) strand; PAM type: YTN; PAM sequence: TTG
gcacttgtattagttctata

SEQ ID NO: 13377 - DNA, 20 bp, Artificial Sequence
  Description of Artificial Sequence: Synthetic oligonucleotide
  Target: SOD1; (-) strand; PAM type: YTN; PAM sequence: TTT
ggcacttgtattagttctat

SEQ ID NO: 13378 - DNA, 20 bp, Artificial Sequence
  Description of Artificial Sequence: Synthetic oligonucleotide
  Target: SOD1; (-) strand; PAM type: YTN; PAM sequence: CTT
tggcacttgtattagttcta

SEQ ID NO: 13379 - DNA, 20 bp, Artificial Sequence
  Description of Artificial Sequence: Synthetic oligonucleotide
  Target: SOD1; (-) strand; PAM type: YTN; PAM sequence: TTC
ccctttggcacttgtattag

SEQ ID NO: 13380 - DNA, 20 bp, Artificial Sequence
  Description of Artificial Sequence: Synthetic oligonucleotide
  Target: SOD1; (-) strand; PAM type: YTN; PAM sequence: TTA
gttcccctttggcacttgta

SEQ ID NO: 13381 - DNA, 20 bp, Artificial Sequence
  Description of Artificial Sequence: Synthetic oligonucleotide
  Target: SOD1; (-) strand; PAM type: YTN; PAM sequence: CTG
tattagttcccctttggcac

SEQ ID NO: 13382 - DNA, 20 bp, Artificial Sequence
  Description of Artificial Sequence: Synthetic oligonucleotide
  Target: SOD1; (-) strand; PAM type: YTN; PAM sequence: TTC
ctgtattagttcccctttgg

SEQ ID NO: 13383 - DNA, 20 bp, Artificial Sequence
  Description of Artificial Sequence: Synthetic oligonucleotide
  Target: SOD1; (-) strand; PAM type: YTN; PAM sequence: TTT
cctgtattagttcccctttg

SEQ ID NO: 13384 - DNA, 20 bp, Artificial Sequence
  Description of Artificial Sequence: Synthetic oligonucleotide
  Target: SOD1; (-) strand; PAM type: YTN; PAM sequence: TTC
atgacatttcctgtattagt

SEQ ID NO: 13385 - DNA, 20 bp, Artificial Sequence
  Description of Artificial Sequence: Synthetic oligonucleotide
  Target: SOD1; (-) strand; PAM type: YTN; PAM sequence: CTG
ttcatgacatttcctgtatt

SEQ ID NO: 13386 - DNA, 20 bp, Artificial Sequence
  Description of Artificial Sequence: Synthetic oligonucleotide
  Target: SOD1; (-) strand; PAM type: YTN; PAM sequence: TTG
acagtactgttcatgacatt

SEQ ID NO: 13387 - DNA, 20 bp, Artificial Sequence
  Description of Artificial Sequence: Synthetic oligonucleotide
  Target: SOD1; (-) strand; PAM type: YTN; PAM sequence: CTA
gtggttgacagtactgttca

SEQ ID NO: 13388 - DNA, 20 bp, Artificial Sequence
  Description of Artificial Sequence: Synthetic oligonucleotide
  Target: SOD1; (-) strand; PAM type: YTN; PAM sequence: TTG
ctagtggttgacagtactgt

SEQ ID NO: 13389 - DNA, 20 bp, Artificial Sequence
  Description of Artificial Sequence: Synthetic oligonucleotide
  Target: SOD1; (-) strand; PAM type: YTN; PAM sequence: TTT
gctagtggttgacagtactg

SEQ ID NO: 13390 - DNA, 20 bp, Artificial Sequence
  Description of Artificial Sequence: Synthetic oligonucleotide
  Target: SOD1; (-) strand; PAM type: YTN; PAM sequence: TTT
tgctagtggttgacagtact

SEQ ID NO: 13391 - DNA, 20 bp, Artificial Sequence
  Description of Artificial Sequence: Synthetic oligonucleotide
  Target: SOD1; (-) strand; PAM type: YTN; PAM sequence: TTG
attttgctagtggttgacag

SEQ ID NO: 13392 - DNA, 20 bp, Artificial Sequence
  Description of Artificial Sequence: Synthetic oligonucleotide
  Target: SOD1; (-) strand; PAM type: YTN; PAM sequence: TTC
acaatgatgattgattttgc

SEQ ID NO: 13393 - DNA, 20 bp, Artificial Sequence
  Description of Artificial Sequence: Synthetic oligonucleotide
  Target: SOD1; (-) strand; PAM type: YTN; PAM sequence: TTT
cacaatgatgattgattttg

SEQ ID NO: 13394 - DNA, 20 bp, Artificial Sequence
  Description of Artificial Sequence: Synthetic oligonucleotide
  Target: SOD1; (-) strand; PAM type: YTN; PAM sequence: CTA
tgtttcacaatgatgattga

SEQ ID NO: 13395 - DNA, 20 bp, Artificial Sequence
  Description of Artificial Sequence: Synthetic oligonucleotide
  Target: SOD1; (-) strand; PAM type: YTN; PAM sequence: TTC
ctatgtttcacaatgatgat

SEQ ID NO: 13396 - DNA, 20 bp, Artificial Sequence
  Description of Artificial Sequence: Synthetic oligonucleotide
  Target: SOD1; (-) strand; PAM type: YTN; PAM sequence: CTT
cctatgtttcacaatgatga

SEQ ID NO: 13397 - DNA, 20 bp, Artificial Sequence
  Description of Artificial Sequence: Synthetic oligonucleotide
  Target: SOD1; (-) strand; PAM type: YTN; PAM sequence: CTA
cagaagcttcctatgtttca

SEQ ID NO: 13398 - DNA, 20 bp, Artificial Sequence
  Description of Artificial Sequence: Synthetic oligonucleotide
  Target: SOD1; (-) strand; PAM type: YTN; PAM sequence: TTA
tctacagaagcttcctatgt

SEQ ID NO: 13399 - DNA, 20 bp, Artificial Sequence
  Description of Artificial Sequence: Synthetic oligonucleotide
  Target: SOD1; (-) strand; PAM type: YTN; PAM sequence: TTT
atctacagaagcttcctatg

SEQ ID NO: 13400 - DNA, 20 bp, Artificial Sequence
  Description of Artificial Sequence: Synthetic oligonucleotide
  Target: SOD1; (-) strand; PAM type: YTN; PAM sequence: TTT
tatctacagaagcttcctat

SEQ ID NO: 13401 - DNA, 20 bp, Artificial Sequence
  Description of Artificial Sequence: Synthetic oligonucleotide
  Target: SOD1; (-) strand; PAM type: YTN; PAM sequence: TTT
ttatctacagaagcttccta

SEQ ID NO: 13402 - DNA, 20 bp, Artificial Sequence
  Description of Artificial Sequence: Synthetic oligonucleotide
  Target: SOD1; (-) strand; PAM type: YTN; PAM sequence: TTT
tttatctacagaagcttcct

SEQ ID NO: 13403 - DNA, 20 bp, Artificial Sequence
  Description of Artificial Sequence: Synthetic oligonucleotide
  Target: SOD1; (-) strand; PAM type: YTN; PAM sequence: TTT
ttttatctacagaagcttcc

SEQ ID NO: 13404 - DNA, 20 bp, Artificial Sequence
  Description of Artificial Sequence: Synthetic oligonucleotide
  Target: SOD1; (-) strand; PAM type: YTN; PAM sequence: TTT
tttttatctacagaagcttc

SEQ ID NO: 13405 - DNA, 20 bp, Artificial Sequence
  Description of Artificial Sequence: Synthetic oligonucleotide
  Target: SOD1; (-) strand; PAM type: YTN; PAM sequence: TTT
ttttttatctacagaagctt

SEQ ID NO: 13406 - DNA, 20 bp, Artificial Sequence
  Description of Artificial Sequence: Synthetic oligonucleotide
  Target: SOD1; (-) strand; PAM type: YTN; PAM sequence: TTT
tttttttatctacagaagct

SEQ ID NO: 13407 - DNA, 20 bp, Artificial Sequence
  Description of Artificial Sequence: Synthetic oligonucleotide
  Target: SOD1; (-) strand; PAM type: YTN; PAM sequence: TTT
ttttttttatctacagaagc

SEQ ID NO: 13408 - DNA, 20 bp, Artificial Sequence
  Description of Artificial Sequence: Synthetic oligonucleotide
  Target: SOD1; (-) strand; PAM type: YTN; PAM sequence: TTC
agtatcaattttttttttta

SEQ ID NO: 13409 - DNA, 20 bp, Artificial Sequence
  Description of Artificial Sequence: Synthetic oligonucleotide
  Target: SOD1; (-) strand; PAM type: YTN; PAM sequence: TTT
cagtatcaattttttttttt

SEQ ID NO: 13410 - DNA, 20 bp, Artificial Sequence
  Description of Artificial Sequence: Synthetic oligonucleotide
  Target: SOD1; (-) strand; PAM type: YTN; PAM sequence: TTT
tcagtatcaatttttttttt

SEQ ID NO: 13411 - DNA, 20 bp, Artificial Sequence
  Description of Artificial Sequence: Synthetic oligonucleotide
  Target: SOD1; (-) strand; PAM type: YTN; PAM sequence: CTA
gttttcagtatcaatttttt

SEQ ID NO: 13412 - DNA, 20 bp, Artificial Sequence
  Description of Artificial Sequence: Synthetic oligonucleotide
  Target: SOD1; (-) strand; PAM type: YTN; PAM sequence: CTC
gactagttttcagtatcaat

SEQ ID NO: 13413 - DNA, 20 bp, Artificial Sequence
  Description of Artificial Sequence: Synthetic oligonucleotide
  Target: SOD1; (-) strand; PAM type: YTN; PAM sequence: TTC
agaaaacatacacatataaa

SEQ ID NO: 13414 - DNA, 20 bp, Artificial Sequence
  Description of Artificial Sequence: Synthetic oligonucleotide
  Target: SOD1; (-) strand; PAM type: YTN; PAM sequence: TTT
cagaaaacatacacatataa

SEQ ID NO: 13415 - DNA, 20 bp, Artificial Sequence
  Description of Artificial Sequence: Synthetic oligonucleotide
  Target: SOD1; (-) strand; PAM type: YTN; PAM sequence: CTT
tcagaaaacatacacatata

SEQ ID NO: 13416 - DNA, 20 bp, Artificial Sequence
  Description of Artificial Sequence: Synthetic oligonucleotide
  Target: SOD1; (-) strand; PAM type: YTN; PAM sequence: CTG
aaaggctttcagaaaacata

SEQ ID NO: 13417 - DNA, 20 bp, Artificial Sequence
  Description of Artificial Sequence: Synthetic oligonucleotide
  Target: SOD1; (-) strand; PAM type: YTN; PAM sequence: TTC
tgaaaggctttcagaaaaca

SEQ ID NO: 13418 - DNA, 20 bp, Artificial Sequence
  Description of Artificial Sequence: Synthetic oligonucleotide
  Target: SOD1; (-) strand; PAM type: YTN; PAM sequence: TTT
ctgaaaggctttcagaaaac

SEQ ID NO: 13419 - DNA, 20 bp, Artificial Sequence
  Description of Artificial Sequence: Synthetic oligonucleotide
  Target: SOD1; (-) strand; PAM type: YTN; PAM sequence: TTT
tctgaaaggctttcagaaaa

SEQ ID NO: 13420 - DNA, 20 bp, Artificial Sequence
  Description of Artificial Sequence: Synthetic oligonucleotide
  Target: SOD1; (-) strand; PAM type: YTN; PAM sequence: TTT
ttctgaaaggctttcagaaa

SEQ ID NO: 13421 - DNA, 20 bp, Artificial Sequence
  Description of Artificial Sequence: Synthetic oligonucleotide
  Target: SOD1; (-) strand; PAM type: YTN; PAM sequence: TTA
atatttttctgaaaggcttt

SEQ ID NO: 13422 - DNA, 20 bp, Artificial Sequence
  Description of Artificial Sequence: Synthetic oligonucleotide
  Target: SOD1; (-) strand; PAM type: YTN; PAM sequence: TTT
aatatttttctgaaaggctt

SEQ ID NO: 13423 - DNA, 20 bp, Artificial Sequence
  Description of Artificial Sequence: Synthetic oligonucleotide
  Target: SOD1; (-) strand; PAM type: YTN; PAM sequence: TTA
aatttaatatttttctgaaa

SEQ ID NO: 13424 - DNA, 20 bp, Artificial Sequence
  Description of Artificial Sequence: Synthetic oligonucleotide
  Target: SOD1; (-) strand; PAM type: YTN; PAM sequence: CTT
aaatttaatatttttctgaa

SEQ ID NO: 13425 - DNA, 20 bp, Artificial Sequence
  Description of Artificial Sequence: Synthetic oligonucleotide
  Target: SOD1; (-) strand; PAM type: YTN; PAM sequence: TTG
tccttaaatttaatattttt

SEQ ID NO: 13426 - DNA, 20 bp, Artificial Sequence
  Description of Artificial Sequence: Synthetic oligonucleotide
  Target: SOD1; (-) strand; PAM type: YTN; PAM sequence: CTT
gtccttaaatttaatatttt

SEQ ID NO: 13427 - DNA, 20 bp, Artificial Sequence
  Description of Artificial Sequence: Synthetic oligonucleotide
  Target: SOD1; (-) strand; PAM type: YTN; PAM sequence: CTG
atataaaaatcttgtcctta

SEQ ID NO: 13428 - DNA, 20 bp, Artificial Sequence
  Description of Artificial Sequence: Synthetic oligonucleotide
  Target: SOD1; (-) strand; PAM type: YTN; PAM sequence: CTC
tgatataaaaatcttgtcct

SEQ ID NO: 13429 - DNA, 20 bp, Artificial Sequence
  Description of Artificial Sequence: Synthetic oligonucleotide
  Target: SOD1; (-) strand; PAM type: YTN; PAM sequence: CTA
tgtcccaaggcctctgatat

SEQ ID NO: 13430 - DNA, 20 bp, Artificial Sequence
  Description of Artificial Sequence: Synthetic oligonucleotide
  Target: SOD1; (-) strand; PAM type: YTN; PAM sequence: CTA
acaaagctatgtcccaaggc

SEQ ID NO: 13431 - DNA, 20 bp, Artificial Sequence
  Description of Artificial Sequence: Synthetic oligonucleotide
  Target: SOD1; (-) strand; PAM type: YTN; PAM sequence: CTG
gcatagctaacaaagctatg

SEQ ID NO: 13432 - DNA, 20 bp, Artificial Sequence
  Description of Artificial Sequence: Synthetic oligonucleotide
  Target: SOD1; (-) strand; PAM type: YTN; PAM sequence: TTA
ctggcatagctaacaaagct

SEQ ID NO: 13433 - DNA, 20 bp, Artificial Sequence
  Description of Artificial Sequence: Synthetic oligonucleotide
  Target: SOD1; (-) strand; PAM type: YTN; PAM sequence: TTA
attactggcatagctaacaa

SEQ ID NO: 13434 - DNA, 20 bp, Artificial Sequence
  Description of Artificial Sequence: Synthetic oligonucleotide
  Target: SOD1; (-) strand; PAM type: YTN; PAM sequence: CTG
ttaattactggcatagctaa

SEQ ID NO: 13435 - DNA, 20 bp, Artificial Sequence
  Description of Artificial Sequence: Synthetic oligonucleotide
  Target: SOD1; (-) strand; PAM type: YTN; PAM sequence: TTA
tgcctgttaattactggcat

SEQ ID NO: 13436 - DNA, 20 bp, Artificial Sequence
  Description of Artificial Sequence: Synthetic oligonucleotide
  Target: SOD1; (-) strand; PAM type: YTN; PAM sequence: CTG
agttatgcctgttaattact

SEQ ID NO: 13437 - DNA, 20 bp, Artificial Sequence
  Description of Artificial Sequence: Synthetic oligonucleotide
  Target: SOD1; (-) strand; PAM type: YTN; PAM sequence: TTA
ctgagttatgcctgttaatt

SEQ ID NO: 13438 - DNA, 20 bp, Artificial Sequence
  Description of Artificial Sequence: Synthetic oligonucleotide
  Target: SOD1; (-) strand; PAM type: YTN; PAM sequence: CTC
agttactgagttatgcctgt

SEQ ID NO: 13439 - DNA, 20 bp, Artificial Sequence
  Description of Artificial Sequence: Synthetic oligonucleotide
  Target: SOD1; (-) strand; PAM type: YTN; PAM sequence: CTC
tcagttactgagttatgcct

SEQ ID NO: 13440 - DNA, 20 bp, Artificial Sequence
  Description of Artificial Sequence: Synthetic oligonucleotide
  Target: SOD1; (-) strand; PAM type: YTN; PAM sequence: TTC
agaagtaccaaagggtaaac

SEQ ID NO: 13441 - DNA, 20 bp, Artificial Sequence
  Description of Artificial Sequence: Synthetic oligonucleotide
  Target: SOD1; (-) strand; PAM type: YTN; PAM sequence: TTT
cagaagtaccaaagggtaaa

SEQ ID NO: 13442 - DNA, 20 bp, Artificial Sequence
  Description of Artificial Sequence: Synthetic oligonucleotide
  Target: SOD1; (-) strand; PAM type: YTN; PAM sequence: CTG
atttcagaagtaccaaaggg

SEQ ID NO: 13443 - DNA, 20 bp, Artificial Sequence
  Description of Artificial Sequence: Synthetic oligonucleotide
  Target: SOD1; (-) strand; PAM type: YTN; PAM sequence: CTG
cacctgatttcagaagtacc

SEQ ID NO: 13444 - DNA, 20 bp, Artificial Sequence
  Description of Artificial Sequence: Synthetic oligonucleotide
  Target: SOD1; (-) strand; PAM type: YTN; PAM sequence: CTG
ggaagaaagatggggctgca

SEQ ID NO: 13445 - DNA, 20 bp, Artificial Sequence
  Description of Artificial Sequence: Synthetic oligonucleotide
  Target: SOD1; (-) strand; PAM type: YTN; PAM sequence: CTC
tgggaagaaagatggggctg

SEQ ID NO: 13446 - DNA, 20 bp, Artificial Sequence
  Description of Artificial Sequence: Synthetic oligonucleotide
  Target: SOD1; (-) strand; PAM type: YTN; PAM sequence: CTA
atgctctgggaagaaagatg

SEQ ID NO: 13447 - DNA, 20 bp, Artificial Sequence
  Description of Artificial Sequence: Synthetic oligonucleotide
  Target: SOD1; (-) strand; PAM type: YTN; PAM sequence: CTA
cacactaatgctctgggaag

SEQ ID NO: 13448 - DNA, 20 bp, Artificial Sequence
  Description of Artificial Sequence: Synthetic oligonucleotide
  Target: SOD1; (-) strand; PAM type: YTN; PAM sequence: TTC
acgtctacacactaatgctc

SEQ ID NO: 13449 - DNA, 20 bp, Artificial Sequence
  Description of Artificial Sequence: Synthetic oligonucleotide
  Target: SOD1; (-) strand; PAM type: YTN; PAM sequence: CTT
cacgtctacacactaatgct

SEQ ID NO: 13450 - DNA, 20 bp, Artificial Sequence
  Description of Artificial Sequence: Synthetic oligonucleotide
  Target: SOD1; (-) strand; PAM type: YTN; PAM sequence: TTC
aaacaaggcttcacgtctac

SEQ ID NO: 13451 - DNA, 20 bp, Artificial Sequence
  Description of Artificial Sequence: Synthetic oligonucleotide
  Target: SOD1; (-) strand; PAM type: YTN; PAM sequence: CTT
caaacaaggcttcacgtcta

SEQ ID NO: 13452 - DNA, 20 bp, Artificial Sequence
  Description of Artificial Sequence: Synthetic oligonucleotide
  Target: SOD1; (-) strand; PAM type: YTN; PAM sequence: CTC
ttcaaacaaggcttcacgtc

SEQ ID NO: 13453 - DNA, 20 bp, Artificial Sequence
  Description of Artificial Sequence: Synthetic oligonucleotide
  Target: SOD1; (-) strand; PAM type: YTN; PAM sequence: CTA
aatacagctcttcaaacaag

SEQ ID NO: 13454 - DNA, 20 bp, Artificial Sequence
  Description of Artificial Sequence: Synthetic oligonucleotide
  Target: SOD1; (-) strand; PAM type: YTN; PAM sequence: TTC
taaatacagctcttcaaaca

SEQ ID NO: 13455 - DNA, 20 bp, Artificial Sequence
  Description of Artificial Sequence: Synthetic oligonucleotide
  Target: SOD1; (-) strand; PAM type: YTN; PAM sequence: CTA
ggcattctaaatacagctct

SEQ ID NO: 13456 - DNA, 20 bp, Artificial Sequence
  Description of Artificial Sequence: Synthetic oligonucleotide
  Target: SOD1; (-) strand; PAM type: YTN; PAM sequence: TTG
caaacaagtagctaggcatt

SEQ ID NO: 13457 - DNA, 20 bp, Artificial Sequence
  Description of Artificial Sequence: Synthetic oligonucleotide
  Target: SOD1; (-) strand; PAM type: YTN; PAM sequence: TTT
gcaaacaagtagctaggcat

SEQ ID NO: 13458 - DNA, 20 bp, Artificial Sequence
  Description of Artificial Sequence: Synthetic oligonucleotide
  Target: SOD1; (-) strand; PAM type: YTN; PAM sequence: CTG
agtagacacaaatttgcaaa

SEQ ID NO: 13459 - DNA, 20 bp, Artificial Sequence
  Description of Artificial Sequence: Synthetic oligonucleotide
  Target: SOD1; (-) strand; PAM type: YTN; PAM sequence: TTG
actgagtagacacaaatttg

SEQ ID NO: 13460 - DNA, 20 bp, Artificial Sequence
  Description of Artificial Sequence: Synthetic oligonucleotide
  Target: SOD1; (-) strand; PAM type: YTN; PAM sequence: CTT
gactgagtagacacaaattt

SEQ ID NO: 13461 - DNA, 20 bp, Artificial Sequence
  Description of Artificial Sequence: Synthetic oligonucleotide
  Target: SOD1; (-) strand; PAM type: YTN; PAM sequence: TTA
aaacttgactgagtagacac

SEQ ID NO: 13462 - DNA, 20 bp, Artificial Sequence
  Description of Artificial Sequence: Synthetic oligonucleotide
  Target: SOD1; (-) strand; PAM type: YTN; PAM sequence: CTA
aattaaaacttgactgagta

SEQ ID NO: 13463 - DNA, 20 bp, Artificial Sequence
  Description of Artificial Sequence: Synthetic oligonucleotide
  Target: SOD1; (-) strand; PAM type: YTN; PAM sequence: TTC
atgagctaaattaaaacttg

SEQ ID NO: 13464 - DNA, 20 bp, Artificial Sequence
  Description of Artificial Sequence: Synthetic oligonucleotide
  Target: SOD1; (-) strand; PAM type: YTN; PAM sequence: CTA
aacatcaaggtagttcatga

SEQ ID NO: 13465 - DNA, 20 bp, Artificial Sequence
  Description of Artificial Sequence: Synthetic oligonucleotide
  Target: SOD1; (-) strand; PAM type: YTN; PAM sequence: CTG
atgccactaaacatcaaggt

SEQ ID NO: 13466 - DNA, 20 bp, Artificial Sequence
  Description of Artificial Sequence: Synthetic oligonucleotide
  Target: SOD1; (-) strand; PAM type: YTN; PAM sequence: TTA
gggctgatgccactaaacat

SEQ ID NO: 13467 - DNA, 20 bp, Artificial Sequence
  Description of Artificial Sequence: Synthetic oligonucleotide
  Target: SOD1; (-) strand; PAM type: YTN; PAM sequence: CTA
ataatgaaaaagcatcagat

SEQ ID NO: 13468 - DNA, 20 bp, Artificial Sequence
  Description of Artificial Sequence: Synthetic oligonucleotide
  Target: SOD1; (-) strand; PAM type: YTN; PAM sequence: CTC
caacatgcctaataatgaaa

SEQ ID NO: 13469 - DNA, 20 bp, Artificial Sequence
  Description of Artificial Sequence: Synthetic oligonucleotide
  Target: SOD1; (-) strand; PAM type: YTN; PAM sequence: TTG
cccaagtctccaacatgcct

SEQ ID NO: 13470 - DNA, 20 bp, Artificial Sequence
  Description of Artificial Sequence: Synthetic oligonucleotide
  Target: SOD1; (-) strand; PAM type: YTN; PAM sequence: TTG
tcagcagtcacattgcccaa

SEQ ID NO: 13471 - DNA, 20 bp, Artificial Sequence
  Description of Artificial Sequence: Synthetic oligonucleotide
  Target: SOD1; (-) strand; PAM type: YTN; PAM sequence: TTT
gtcagcagtcacattgccca

SEQ ID NO: 13472 - DNA, 20 bp, Artificial Sequence
  Description of Artificial Sequence: Synthetic oligonucleotide
  Target: SOD1; (-) strand; PAM type: YTN; PAM sequence: CTT
tgtcagcagtcacattgccc

SEQ ID NO: 13473 - DNA, 20 bp, Artificial Sequence
  Description of Artificial Sequence: Synthetic oligonucleotide
  Target: SOD1; (-) strand; PAM type: YTN; PAM sequence: TTC
aatagacacatcggccacac

SEQ ID NO: 13474 - DNA, 20 bp, Artificial Sequence
  Description of Artificial Sequence: Synthetic oligonucleotide
  Target: SOD1; (-) strand; PAM type: YTN; PAM sequence: CTT
caatagacacatcggccaca

SEQ ID NO: 13475 - DNA, 20 bp, Artificial Sequence
  Description of Artificial Sequence: Synthetic oligonucleotide
  Target: SOD1; (-) strand; PAM type: YTN; PAM sequence: CTG
agagtgagatcacagaatct

SEQ ID NO: 13476 - DNA, 20 bp, Artificial Sequence
  Description of Artificial Sequence: Synthetic oligonucleotide
  Target: SOD1; (-) strand; PAM type: YTN; PAM sequence: CTC
ctgagagtgagatcacagaa

SEQ ID NO: 13477 - DNA, 20 bp, Artificial Sequence
  Description of Artificial Sequence: Synthetic oligonucleotide
  Target: SOD1; (-) strand; PAM type: YTN; PAM sequence: TTA
ccaccagtgtgcggccaatg

SEQ ID NO: 13478 - DNA, 20 bp, Artificial Sequence
  Description of Artificial Sequence: Synthetic oligonucleotide
  Target: SOD1; (-) strand; PAM type: YTN; PAM sequence: CTT
accaccagtgtgcggccaat

SEQ ID NO: 13479 - DNA, 20 bp, Artificial Sequence
  Description of Artificial Sequence: Synthetic oligonucleotide
  Target: SOD1; (-) strand; PAM type: YTN; PAM sequence: TTA
tgaaaacttaccaccagtgt

SEQ ID NO: 13480 - DNA, 20 bp, Artificial Sequence
  Description of Artificial Sequence: Synthetic oligonucleotide
  Target: SOD1; (-) strand; PAM type: YTN; PAM sequence: TTT
atgaaaacttaccaccagtg

SEQ ID NO: 13481 - DNA, 20 bp, Artificial Sequence
  Description of Artificial Sequence: Synthetic oligonucleotide
  Target: SOD1; (-) strand; PAM type: YTN; PAM sequence: TTT
tatgaaaacttaccaccagt

SEQ ID NO: 13482 - DNA, 20 bp, Artificial Sequence
  Description of Artificial Sequence: Synthetic oligonucleotide
  Target: SOD1; (-) strand; PAM type: YTN; PAM sequence: CTT
ttatgaaaacttaccaccag

SEQ ID NO: 13483 - DNA, 20 bp, Artificial Sequence
  Description of Artificial Sequence: Synthetic oligonucleotide
  Target: SOD1; (-) strand; PAM type: YTN; PAM sequence: TTA
tgcatatccttttatgaaaa

SEQ ID NO: 13484 - DNA, 20 bp, Artificial Sequence
  Description of Artificial Sequence: Synthetic oligonucleotide
  Target: SOD1; (-) strand; PAM type: YTN; PAM sequence: TTT
atgcatatccttttatgaaa

SEQ ID NO: 13485 - DNA, 20 bp, Artificial Sequence
  Description of Artificial Sequence: Synthetic oligonucleotide
  Target: SOD1; (-) strand; PAM type: YTN; PAM sequence: TTT
tatgcatatccttttatgaa

SEQ ID NO: 13486 - DNA, 20 bp, Artificial Sequence
  Description of Artificial Sequence: Synthetic oligonucleotide
  Target: SOD1; (-) strand; PAM type: YTN; PAM sequence: TTA
gaagaagttttatgcatatc

SEQ ID NO: 13487 - DNA, 20 bp, Artificial Sequence
  Description of Artificial Sequence: Synthetic oligonucleotide
  Target: SOD1; (-) strand; PAM type: YTN; PAM sequence: CTG
tatgttagaagaagttttat

SEQ ID NO: 13488 - DNA, 20 bp, Artificial Sequence
  Description of Artificial Sequence: Synthetic oligonucleotide
  Target: SOD1; (-) strand; PAM type: YTN; PAM sequence: CTA
acaatcaaagtgaaaagata

SEQ ID NO: 13489 - DNA, 20 bp, Artificial Sequence
  Description of Artificial Sequence: Synthetic oligonucleotide
  Target: SOD1; (-) strand; PAM type: YTN; PAM sequence: TTA
gaaaccgcgactaacaatca

SEQ ID NO: 13490 - DNA, 20 bp, Artificial Sequence
  Description of Artificial Sequence: Synthetic oligonucleotide
  Target: SOD1; (-) strand; PAM type: YTN; PAM sequence: TTT
agaaaccgcgactaacaatc

SEQ ID NO: 13491 - DNA, 20 bp, Artificial Sequence
  Description of Artificial Sequence: Synthetic oligonucleotide
  Target: SOD1; (-) strand; PAM type: YTN; PAM sequence: CTT
tagaaaccgcgactaacaat

SEQ ID NO: 13492 - DNA, 20 bp, Artificial Sequence
  Description of Artificial Sequence: Synthetic oligonucleotide
  Target: SOD1; (-) strand; PAM type: YTN; PAM sequence: CTG
gatctttagaaaccgcgact

SEQ ID NO: 13493 - DNA, 20 bp, Artificial Sequence
  Description of Artificial Sequence: Synthetic oligonucleotide
  Target: SOD1; (-) strand; PAM type: YTN; PAM sequence: TTA
tctggatctttagaaaccgc

SEQ ID NO: 13494 - DNA, 20 bp, Artificial Sequence
  Description of Artificial Sequence: Synthetic oligonucleotide
  Target: SOD1; (-) strand; PAM type: YTN; PAM sequence: TTT
atctggatctttagaaaccg

SEQ ID NO: 13495 - DNA, 20 bp, Artificial Sequence
  Description of Artificial Sequence: Synthetic oligonucleotide
  Target: SOD1; (-) strand; PAM type: YTN; PAM sequence: CTG
caagtacagtttatctggat

SEQ ID NO: 13496 - DNA, 20 bp, Artificial Sequence
  Description of Artificial Sequence: Synthetic oligonucleotide
  Target: SOD1; (-) strand; PAM type: YTN; PAM sequence: TTG
aactgcaagtacagtttatc

SEQ ID NO: 13497 - DNA, 20 bp, Artificial Sequence
  Description of Artificial Sequence: Synthetic oligonucleotide
  Target: SOD1; (-) strand; PAM type: YTN; PAM sequence: TTT
gaactgcaagtacagtttat

SEQ ID NO: 13498 - DNA, 20 bp, Artificial Sequence
  Description of Artificial Sequence: Synthetic oligonucleotide
  Target: SOD1; (-) strand; PAM type: YTN; PAM sequence: CTA
atttgaactgcaagtacagt

SEQ ID NO: 13499 - DNA, 20 bp, Artificial Sequence
  Description of Artificial Sequence: Synthetic oligonucleotide
  Target: SOD1; (-) strand; PAM type: YTN; PAM sequence: TTC
ctaatttgaactgcaagtac

SEQ ID NO: 13500 - DNA, 20 bp, Artificial Sequence
  Description of Artificial Sequence: Synthetic oligonucleotide
  Target: SOD1; (-) strand; PAM type: YTN; PAM sequence: TTT
cctaatttgaactgcaagta

SEQ ID NO: 13501 - DNA, 20 bp, Artificial Sequence
  Description of Artificial Sequence: Synthetic oligonucleotide
  Target: SOD1; (-) strand; PAM type: YTN; PAM sequence: TTT
tcctaatttgaactgcaagt

SEQ ID NO: 13502 - DNA, 20 bp, Artificial Sequence
  Description of Artificial Sequence: Synthetic oligonucleotide
  Target: SOD1; (-) strand; PAM type: YTN; PAM sequence: CTT
ttcctaatttgaactgcaag

SEQ ID NO: 13503 - DNA, 20 bp, Artificial Sequence
  Description of Artificial Sequence: Synthetic oligonucleotide
  Target: SOD1; (-) strand; PAM type: YTN; PAM sequence: TTG
cttttcctaatttgaactgc

SEQ ID NO: 13504 - DNA, 20 bp, Artificial Sequence
  Description of Artificial Sequence: Synthetic oligonucleotide
  Target: SOD1; (-) strand; PAM type: YTN; PAM sequence: TTG
tccaataaaattgcttttcc

SEQ ID NO: 13505 - DNA, 20 bp, Artificial Sequence
  Description of Artificial Sequence: Synthetic oligonucleotide
  Target: SOD1; (-) strand; PAM type: YTN; PAM sequence: TTC
accgtaattgtccaataaaa

SEQ ID NO: 13506 - DNA, 20 bp, Artificial Sequence
  Description of Artificial Sequence: Synthetic oligonucleotide
  Target: SOD1; (-) strand; PAM type: YTN; PAM sequence: TTT
caccgtaattgtccaataaa

SEQ ID NO: 13507 - DNA, 20 bp, Artificial Sequence
  Description of Artificial Sequence: Synthetic oligonucleotide
  Target: SOD1; (-) strand; PAM type: YTN; PAM sequence: TTT
tcaccgtaattgtccaataa

SEQ ID NO: 13508 - DNA, 20 bp, Artificial Sequence
  Description of Artificial Sequence: Synthetic oligonucleotide
  Target: SOD1; (-) strand; PAM type: YTN; PAM sequence: TTC
attttcaccgtaattgtcca

SEQ ID NO: 13509 - DNA, 20 bp, Artificial Sequence
  Description of Artificial Sequence: Synthetic oligonucleotide
  Target: SOD1; (-) strand; PAM type: YTN; PAM sequence: CTA
gataaaataattcattttca

SEQ ID NO: 13510 - DNA, 20 bp, Artificial Sequence
  Description of Artificial Sequence: Synthetic oligonucleotide
  Target: SOD1; (-) strand; PAM type: YTN; PAM sequence: CTG
acctagataaaataattcat

SEQ ID NO: 13511 - DNA, 20 bp, Artificial Sequence
  Description of Artificial Sequence: Synthetic oligonucleotide
  Target: SOD1; (-) strand; PAM type: YTN; PAM sequence: TTA
actgacctagataaaataat

SEQ ID NO: 13512 - DNA, 20 bp, Artificial Sequence
  Description of Artificial Sequence: Synthetic oligonucleotide
  Target: SOD1; (-) strand; PAM type: YTN; PAM sequence: CTT
aactgacctagataaaataa

SEQ ID NO: 13513 - DNA, 20 bp, Artificial Sequence
  Description of Artificial Sequence: Synthetic oligonucleotide
  Target: SOD1; (-) strand; PAM type: YTN; PAM sequence: TTC
ttaactgacctagataaaat

SEQ ID NO: 13514 - DNA, 20 bp, Artificial Sequence
  Description of Artificial Sequence: Synthetic oligonucleotide
  Target: SOD1; (-) strand; PAM type: YTN; PAM sequence: TTA
gcagaacagtgttcttaact

SEQ ID NO: 13515 - DNA, 20 bp, Artificial Sequence
  Description of Artificial Sequence: Synthetic oligonucleotide
  Target: SOD1; (-) strand; PAM type: YTN; PAM sequence: CTT
agcagaacagtgttcttaac

SEQ ID NO: 13516 - DNA, 20 bp, Artificial Sequence
  Description of Artificial Sequence: Synthetic oligonucleotide
  Target: SOD1; (-) strand; PAM type: YTN; PAM sequence: CTG
catcttagcagaacagtgtt

SEQ ID NO: 13517 - DNA, 20 bp, Artificial Sequence
  Description of Artificial Sequence: Synthetic oligonucleotide
  Target: SOD1; (-) strand; PAM type: YTN; PAM sequence: TTA
ctgcatcttagcagaacagt

SEQ ID NO: 13518 - DNA, 20 bp, Artificial Sequence
  Description of Artificial Sequence: Synthetic oligonucleotide
  Target: SOD1; (-) strand; PAM type: YTN; PAM sequence: TTT
actgcatcttagcagaacag

SEQ ID NO: 13519 - DNA, 20 bp, Artificial Sequence
  Description of Artificial Sequence: Synthetic oligonucleotide
  Target: SOD1; (-) strand; PAM type: YTN; PAM sequence: TTT
tactgcatcttagcagaaca

SEQ ID NO: 13520 - DNA, 20 bp, Artificial Sequence
  Description of Artificial Sequence: Synthetic oligonucleotide
  Target: SOD1; (-) strand; PAM type: YTN; PAM sequence: TTT
ttactgcatcttagcagaac

SEQ ID NO: 13521 - DNA, 20 bp, Artificial Sequence
  Description of Artificial Sequence: Synthetic oligonucleotide
  Target: SOD1; (-) strand; PAM type: YTN; PAM sequence: CTT
tttactgcatcttagcagaa

SEQ ID NO: 13522 - DNA, 20 bp, Artificial Sequence
  Description of Artificial Sequence: Synthetic oligonucleotide
  Target: SOD1; (-) strand; PAM type: YTN; PAM sequence: CTG
ctttttactgcatcttagca

SEQ ID NO: 13523 - DNA, 20 bp, Artificial Sequence
  Description of Artificial Sequence: Synthetic oligonucleotide
  Target: SOD1; (-) strand; PAM type: YTN; PAM sequence: CTA
atatggtcaaatgtaacctg

SEQ ID NO: 13524 - DNA, 20 bp, Artificial Sequence
  Description of Artificial Sequence: Synthetic oligonucleotide
  Target: SOD1; (-) strand; PAM type: YTN; PAM sequence: CTC
agatctaatatggtcaaatg

SEQ ID NO: 13525 - DNA, 20 bp, Artificial Sequence
  Description of Artificial Sequence: Synthetic oligonucleotide
  Target: SOD1; (-) strand; PAM type: YTN; PAM sequence: TTC
caaactcagatctaatatgg

SEQ ID NO: 13526 - DNA, 20 bp, Artificial Sequence
  Description of Artificial Sequence: Synthetic oligonucleotide
  Target: SOD1; (-) strand; PAM type: YTN; PAM sequence: TTT
ccaaactcagatctaatatg

SEQ ID NO: 13527 - DNA, 20 bp, Artificial Sequence
  Description of Artificial Sequence: Synthetic oligonucleotide
  Target: SOD1; (-) strand; PAM type: YTN; PAM sequence: TTT
tccaaactcagatctaatat

SEQ ID NO: 13528 - DNA, 20 bp, Artificial Sequence
  Description of Artificial Sequence: Synthetic oligonucleotide
  Target: SOD1; (-) strand; PAM type: YTN; PAM sequence: CTG
ttttccaaactcagatctaa

SEQ ID NO: 13529 - DNA, 20 bp, Artificial Sequence
  Description of Artificial Sequence: Synthetic oligonucleotide
  Target: SOD1; (-) strand; PAM type: YTN; PAM sequence: TTC
tgttttccaaactcagatct

SEQ ID NO: 13530 - DNA, 20 bp, Artificial Sequence
  Description of Artificial Sequence: Synthetic oligonucleotide
  Target: SOD1; (-) strand; PAM type: YTN; PAM sequence: CTT
ctgttttccaaactcagatc

SEQ ID NO: 13531 - DNA, 20 bp, Artificial Sequence
  Description of Artificial Sequence: Synthetic oligonucleotide
  Target: SOD1; (-) strand; PAM type: YTN; PAM sequence: CTA
cttctgttttccaaactcag

SEQ ID NO: 13532 - DNA, 20 bp, Artificial Sequence
  Description of Artificial Sequence: Synthetic oligonucleotide
  Target: SOD1; (-) strand; PAM type: YTN; PAM sequence: CTA
aagactacttctgttttcca

SEQ ID NO: 13533 - DNA, 20 bp, Artificial Sequence
  Description of Artificial Sequence: Synthetic oligonucleotide
  Target: SOD1; (-) strand; PAM type: YTN; PAM sequence: TTA
aaactaaagactacttctgt

SEQ ID NO: 13534 - DNA, 20 bp, Artificial Sequence
  Description of Artificial Sequence: Synthetic oligonucleotide
  Target: SOD1; (-) strand; PAM type: YTN; PAM sequence: TTT
aaaactaaagactacttctg

SEQ ID NO: 13535 - DNA, 20 bp, Artificial Sequence
  Description of Artificial Sequence: Synthetic oligonucleotide
  Target: SOD1; (-) strand; PAM type: YTN; PAM sequence: TTT
taaaactaaagactacttct

SEQ ID NO: 13536 - DNA, 20 bp, Artificial Sequence
  Description of Artificial Sequence: Synthetic oligonucleotide
  Target: SOD1; (-) strand; PAM type: YTN; PAM sequence: CTG
gccattttaaaactaaagac

SEQ ID NO: 13537 - DNA, 20 bp, Artificial Sequence
  Description of Artificial Sequence: Synthetic oligonucleotide
  Target: SOD1; (-) strand; PAM type: YTN; PAM sequence: CTG
gcaagaaaatctggccattt

SEQ ID NO: 13538 - DNA, 20 bp, Artificial Sequence
  Description of Artificial Sequence: Synthetic oligonucleotide
  Target: SOD1; (-) strand; PAM type: YTN; PAM sequence: TTA
acaagtgagaaacccaatcc

SEQ ID NO: 13539 - DNA, 20 bp, Artificial Sequence
  Description of Artificial Sequence: Synthetic oligonucleotide
  Target: SOD1; (-) strand; PAM type: YTN; PAM sequence: TTT
aacaagtgagaaacccaatc

SEQ ID NO: 13540 - DNA, 20 bp, Artificial Sequence
  Description of Artificial Sequence: Synthetic oligonucleotide
  Target: SOD1; (-) strand; PAM type: YTN; PAM sequence: CTG
tttaacaagtgagaaaccca

SEQ ID NO: 13541 - DNA, 20 bp, Artificial Sequence
  Description of Artificial Sequence: Synthetic oligonucleotide
  Target: SOD1; (-) strand; PAM type: YTN; PAM sequence: TTC
tgtttaacaagtgagaaacc

SEQ ID NO: 13542 - DNA, 20 bp, Artificial Sequence
  Description of Artificial Sequence: Synthetic oligonucleotide
  Target: SOD1; (-) strand; PAM type: YTN; PAM sequence: TTA
acaaaatgttctgtttaaca

SEQ ID NO: 13543 - DNA, 20 bp, Artificial Sequence
  Description of Artificial Sequence: Synthetic oligonucleotide
  Target: SOD1; (-) strand; PAM type: YTN; PAM sequence: CTT
aacaaaatgttctgtttaac

SEQ ID NO: 13544 - DNA, 20 bp, Artificial Sequence
  Description of Artificial Sequence: Synthetic oligonucleotide
  Target: SOD1; (-) strand; PAM type: YTN; PAM sequence: TTA
aacttaacaaaatgttctgt

SEQ ID NO: 13545 - DNA, 20 bp, Artificial Sequence
  Description of Artificial Sequence: Synthetic oligonucleotide
  Target: SOD1; (-) strand; PAM type: YTN; PAM sequence: TTT
aaacttaacaaaatgttctg

SEQ ID NO: 13546 - DNA, 20 bp, Artificial Sequence
  Description of Artificial Sequence: Synthetic oligonucleotide
  Target: SOD1; (-) strand; PAM type: YTN; PAM sequence: TTT
taaacttaacaaaatgttct

SEQ ID NO: 13547 - DNA, 20 bp, Artificial Sequence
  Description of Artificial Sequence: Synthetic oligonucleotide
  Target: SOD1; (-) strand; PAM type: YTN; PAM sequence: TTA
agtccatcccaggttttaaa

SEQ ID NO: 13548 - DNA, 20 bp, Artificial Sequence
  Description of Artificial Sequence: Synthetic oligonucleotide
  Target: SOD1; (-) strand; PAM type: YTN; PAM sequence: CTT
aagtccatcccaggttttaa

SEQ ID NO: 13549 - DNA, 20 bp, Artificial Sequence
  Description of Artificial Sequence: Synthetic oligonucleotide
  Target: SOD1; (-) strand; PAM type: YTN; PAM sequence: CTG
aatgaacatgaatgaacatg

SEQ ID NO: 13550 - DNA, 20 bp, Artificial Sequence
  Description of Artificial Sequence: Synthetic oligonucleotide
  Target: SOD1; (-) strand; PAM type: YTN; PAM sequence: CTG
cagtcctgaatgaacatgaa

SEQ ID NO: 13551 - DNA, 20 bp, Artificial Sequence
  Description of Artificial Sequence: Synthetic oligonucleotide
  Target: SOD1; (-) strand; PAM type: YTN; PAM sequence: TTA
aacaagtcatgataacctgc

SEQ ID NO: 13552 - DNA, 20 bp, Artificial Sequence
  Description of Artificial Sequence: Synthetic oligonucleotide
  Target: SOD1; (-) strand; PAM type: YTN; PAM sequence: TTC
ccacaagttaaacaagtcat

SEQ ID NO: 13553 - DNA, 20 bp, Artificial Sequence
  Description of Artificial Sequence: Synthetic oligonucleotide
  Target: SOD1; (-) strand; PAM type: YTN; PAM sequence: CTT
cccacaagttaaacaagtca

SEQ ID NO: 13554 - DNA, 20 bp, Artificial Sequence
  Description of Artificial Sequence: Synthetic oligonucleotide
  Target: SOD1; (-) strand; PAM type: YTN; PAM sequence: TTG
ggacaacagcttcccacaag

SEQ ID NO: 13555 - DNA, 20 bp, Artificial Sequence
  Description of Artificial Sequence: Synthetic oligonucleotide
  Target: SOD1; (-) strand; PAM type: YTN; PAM sequence: CTT
gggacaacagcttcccacaa

SEQ ID NO: 13556 - DNA, 20 bp, Artificial Sequence
  Description of Artificial Sequence: Synthetic oligonucleotide
  Target: SOD1; (-) strand; PAM type: YTN; PAM sequence: TTC
cccaggataacttgggacaa

SEQ ID NO: 13557 - DNA, 20 bp, Artificial Sequence
  Description of Artificial Sequence: Synthetic oligonucleotide
  Target: SOD1; (-) strand; PAM type: YTN; PAM sequence: TTG
caagaaccagatgcagttcc

SEQ ID NO: 13558 - DNA, 20 bp, Artificial Sequence
  Description of Artificial Sequence: Synthetic oligonucleotide
  Target: SOD1; (-) strand; PAM type: YTN; PAM sequence: TTT
gcaagaaccagatgcagttc

SEQ ID NO: 13559 - DNA, 20 bp, Artificial Sequence
  Description of Artificial Sequence: Synthetic oligonucleotide
  Target: SOD1; (-) strand; PAM type: YTN; PAM sequence: TTT
tgcaagaaccagatgcagtt

SEQ ID NO: 13560 - DNA, 20 bp, Artificial Sequence
  Description of Artificial Sequence: Synthetic oligonucleotide
  Target: SOD1; (-) strand; PAM type: YTN; PAM sequence: TTG
gtgttttgcaagaaccagat

SEQ ID NO: 13561 - DNA, 20 bp, Artificial Sequence
  Description of Artificial Sequence: Synthetic oligonucleotide
  Target: SOD1; (-) strand; PAM type: YTN; PAM sequence: CTT
ggtgttttgcaagaaccaga

SEQ ID NO: 13562 - DNA, 20 bp, Artificial Sequence
  Description of Artificial Sequence: Synthetic oligonucleotide
  Target: SOD1; (-) strand; PAM type: YTN; PAM sequence: CTA
cttggtgttttgcaagaacc

SEQ ID NO: 13563 - DNA, 20 bp, Artificial Sequence
  Description of Artificial Sequence: Synthetic oligonucleotide
  Target: SOD1; (-) strand; PAM type: YTN; PAM sequence: CTG
tctacttggtgttttgcaag

SEQ ID NO: 13564 - DNA, 20 bp, Artificial Sequence
  Description of Artificial Sequence: Synthetic oligonucleotide
  Target: SOD1; (-) strand; PAM type: YTN; PAM sequence: CTC
aaggggaggtaaaagagagc

SEQ ID NO: 13565 - DNA, 20 bp, Artificial Sequence
  Description of Artificial Sequence: Synthetic oligonucleotide
  Target: SOD1; (-) strand; PAM type: YTN; PAM sequence: TTA
atgccctcaaggggaggtaa

SEQ ID NO: 13566 - DNA, 20 bp, Artificial Sequence
  Description of Artificial Sequence: Synthetic oligonucleotide
  Target: SOD1; (-) strand; PAM type: YTN; PAM sequence: CTG
aatgttaatgccctcaaggg

SEQ ID NO: 13567 - DNA, 20 bp, Artificial Sequence
  Description of Artificial Sequence: Synthetic oligonucleotide
  Target: SOD1; (-) strand; PAM type: YTN; PAM sequence: CTA
ctgaatgttaatgccctcaa

SEQ ID NO: 13568 - DNA, 20 bp, Artificial Sequence
  Description of Artificial Sequence: Synthetic oligonucleotide
  Target: SOD1; (-) strand; PAM type: YTN; PAM sequence: CTG
aatggaagtgactactgaat

SEQ ID NO: 13569 - DNA, 20 bp, Artificial Sequence
  Description of Artificial Sequence: Synthetic oligonucleotide
  Target: SOD1; (-) strand; PAM type: YTN; PAM sequence: TTA
actgaatggaagtgactact

SEQ ID NO: 13570 - DNA, 20 bp, Artificial Sequence
  Description of Artificial Sequence: Synthetic oligonucleotide
  Target: SOD1; (-) strand; PAM type: YTN; PAM sequence: CTC
aagaaaaaccataaaaataa

SEQ ID NO: 13571 - DNA, 20 bp, Artificial Sequence
  Description of Artificial Sequence: Synthetic oligonucleotide
  Target: SOD1; (-) strand; PAM type: YTN; PAM sequence: CTA
tggctcaagaaaaaccataa

SEQ ID NO: 13572 - DNA, 20 bp, Artificial Sequence
  Description of Artificial Sequence: Synthetic oligonucleotide
  Target: SOD1; (-) strand; PAM type: YTN; PAM sequence: TTA
caactatggctcaagaaaaa

SEQ ID NO: 13573 - DNA, 20 bp, Artificial Sequence
  Description of Artificial Sequence: Synthetic oligonucleotide
  Target: SOD1; (-) strand; PAM type: YTN; PAM sequence: TTT
acaactatggctcaagaaaa

SEQ ID NO: 13574 - DNA, 20 bp, Artificial Sequence
  Description of Artificial Sequence: Synthetic oligonucleotide
  Target: SOD1; (-) strand; PAM type: YTN; PAM sequence: CTT
tacaactatggctcaagaaa

SEQ ID NO: 13575 - DNA, 20 bp, Artificial Sequence
  Description of Artificial Sequence: Synthetic oligonucleotide
  Target: SOD1; (-) strand; PAM type: YTN; PAM sequence: CTG
ctttacaactatggctcaag

SEQ ID NO: 13576 - DNA, 20 bp, Artificial Sequence
  Description of Artificial Sequence: Synthetic oligonucleotide
  Target: SOD1; (-) strand; PAM type: YTN; PAM sequence: TTC
tgctttacaactatggctca

SEQ ID NO: 13577 - DNA, 20 bp, Artificial Sequence
  Description of Artificial Sequence: Synthetic oligonucleotide
  Target: SOD1; (-) strand; PAM type: YTN; PAM sequence: TTT
ctgctttacaactatggctc

SEQ ID NO: 13578 - DNA, 20 bp, Artificial Sequence
  Description of Artificial Sequence: Synthetic oligonucleotide
  Target: SOD1; (-) strand; PAM type: YTN; PAM sequence: TTT
tctgctttacaactatggct

SEQ ID NO: 13579 - DNA, 20 bp, Artificial Sequence
  Description of Artificial Sequence: Synthetic oligonucleotide
  Target: SOD1; (-) strand; PAM type: YTN; PAM sequence: TTT
ttctgctttacaactatggc

SEQ ID NO: 13580 - DNA, 20 bp, Artificial Sequence
  Description of Artificial Sequence: Synthetic oligonucleotide
  Target: SOD1; (-) strand; PAM type: YTN; PAM sequence: TTA
taaatgatttttctgcttta

SEQ ID NO: 13581 - DNA, 20 bp, Artificial Sequence
  Description of Artificial Sequence: Synthetic oligonucleotide
  Target: SOD1; (-) strand; PAM type: YTN; PAM sequence: TTT
ataaatgatttttctgcttt

SEQ ID NO: 13582 - DNA, 20 bp, Artificial Sequence
  Description of Artificial Sequence: Synthetic oligonucleotide
  Target: SOD1; (-) strand; PAM type: YTN; PAM sequence: CTT
tataaatgatttttctgctt

SEQ ID NO: 13583 - DNA, 20 bp, Artificial Sequence
  Description of Artificial Sequence: Synthetic oligonucleotide
  Target: SOD1; (-) strand; PAM type: YTN; PAM sequence: TTC
aacaaacctttataaatgat

SEQ ID NO: 13584 - DNA, 20 bp, Artificial Sequence
  Description of Artificial Sequence: Synthetic oligonucleotide
  Target: SOD1; (-) strand; PAM type: YTN; PAM sequence: TTG
ttcaacaaacctttataaat

SEQ ID NO: 13585 - DNA, 20 bp, Artificial Sequence
  Description of Artificial Sequence: Synthetic oligonucleotide
  Target: SOD1; (-) strand; PAM type: YTN; PAM sequence: TTT
gttcaacaaacctttataaa

SEQ ID NO: 13586 - DNA, 20 bp, Artificial Sequence
  Description of Artificial Sequence: Synthetic oligonucleotide
  Target: SOD1; (-) strand; PAM type: YTN; PAM sequence: TTT
tgttcaacaaacctttataa

SEQ ID NO: 13587 - DNA, 20 bp, Artificial Sequence
  Description of Artificial Sequence: Synthetic oligonucleotide
  Target: SOD1; (-) strand; PAM type: YTN; PAM sequence: TTG
aattttgttcaacaaacctt

SEQ ID NO: 13588 - DNA, 20 bp, Artificial Sequence
  Description of Artificial Sequence: Synthetic oligonucleotide
  Target: SOD1; (-) strand; PAM type: YTN; PAM sequence: TTT
gaattttgttcaacaaacct

SEQ ID NO: 13589 - DNA, 20 bp, Artificial Sequence
  Description of Artificial Sequence: Synthetic oligonucleotide
  Target: SOD1; (-) strand; PAM type: YTN; PAM sequence: TTT
tgaattttgttcaacaaacc

SEQ ID NO: 13590 - DNA, 20 bp, Artificial Sequence
  Description of Artificial Sequence: Synthetic oligonucleotide
  Target: SOD1; (-) strand; PAM type: YTN; PAM sequence: TTA
agcaacagtattttgaattt

SEQ ID NO: 13591 - DNA, 20 bp, Artificial Sequence
  Description of Artificial Sequence: Synthetic oligonucleotide
  Target: SOD1; (-) strand; PAM type: YTN; PAM sequence: TTT
aagcaacagtattttgaatt

SEQ ID NO: 13592 - DNA, 20 bp, Artificial Sequence
  Description of Artificial Sequence: Synthetic oligonucleotide
  Target: SOD1; (-) strand; PAM type: YTN; PAM sequence: CTT
taagcaacagtattttgaat

SEQ ID NO: 13593 - DNA, 20 bp, Artificial Sequence
  Description of Artificial Sequence: Synthetic oligonucleotide
  Target: SOD1; (-) strand; PAM type: YTN; PAM sequence: TTA
atactttaagcaacagtatt

SEQ ID NO: 13594 - DNA, 20 bp, Artificial Sequence
  Description of Artificial Sequence: Synthetic oligonucleotide
  Target: SOD1; (-) strand; PAM type: YTN; PAM sequence: CTT
aatactttaagcaacagtat

SEQ ID NO: 13595 - DNA, 20 bp, Artificial Sequence
  Description of Artificial Sequence: Synthetic oligonucleotide
  Target: SOD1; (-) strand; PAM type: YTN; PAM sequence: CTA
aaaaatcttaatactttaag

SEQ ID NO: 13596 - DNA, 20 bp, Artificial Sequence
  Description of Artificial Sequence: Synthetic oligonucleotide
  Target: SOD1; (-) strand; PAM type: YTN; PAM sequence: CTA
taagtaaggtataatcctaa

SEQ ID NO: 13597 - DNA, 20 bp, Artificial Sequence
  Description of Artificial Sequence: Synthetic oligonucleotide
  Target: SOD1; (-) strand; PAM type: YTN; PAM sequence: TTC
atgccaaatgaatgacgggc

SEQ ID NO: 13598 - DNA, 20 bp, Artificial Sequence
  Description of Artificial Sequence: Synthetic oligonucleotide
  Target: SOD1; (-) strand; PAM type: YTN; PAM sequence: TTT
catgccaaatgaatgacggg

SEQ ID NO: 13599 - DNA, 20 bp, Artificial Sequence
  Description of Artificial Sequence: Synthetic oligonucleotide
  Target: SOD1; (-) strand; PAM type: YTN; PAM sequence: CTC
aaaatttcatgccaaatgaa

SEQ ID NO: 13600 - DNA, 20 bp, Artificial Sequence
  Description of Artificial Sequence: Synthetic oligonucleotide
  Target: SOD1; (-) strand; PAM type: YTN; PAM sequence: TTG
gaaaaaaaggaaagtgaaag

SEQ ID NO: 13601 - DNA, 20 bp, Artificial Sequence
  Description of Artificial Sequence: Synthetic oligonucleotide
  Target: SOD1; (-) strand; PAM type: YTN; PAM sequence: TTT
ggaaaaaaaggaaagtgaaa

SEQ ID NO: 13602 - DNA, 20 bp, Artificial Sequence
  Description of Artificial Sequence: Synthetic oligonucleotide
  Target: SOD1; (-) strand; PAM type: YTN; PAM sequence: CTT
tggaaaaaaaggaaagtgaa

SEQ ID NO: 13603 - DNA, 20 bp, Artificial Sequence
  Description of Artificial Sequence: Synthetic oligonucleotide
  Target: SOD1; (-) strand; PAM type: YTN; PAM sequence: TTG
ctttggaaaaaaaggaaagt

SEQ ID NO: 13604 - DNA, 20 bp, Artificial Sequence
  Description of Artificial Sequence: Synthetic oligonucleotide
  Target: SOD1; (-) strand; PAM type: YTN; PAM sequence: TTA
attgctttggaaaaaaagga

SEQ ID NO: 13605 - DNA, 20 bp, Artificial Sequence
  Description of Artificial Sequence: Synthetic oligonucleotide
  Target: SOD1; (-) strand; PAM type: YTN; PAM sequence: TTT
aattgctttggaaaaaaagg

SEQ ID NO: 13606 - DNA, 20 bp, Artificial Sequence
  Description of Artificial Sequence: Synthetic oligonucleotide
  Target: SOD1; (-) strand; PAM type: YTN; PAM sequence: TTT
taattgctttggaaaaaaag

SEQ ID NO: 13607 - DNA, 20 bp, Artificial Sequence
  Description of Artificial Sequence: Synthetic oligonucleotide
  Target: SOD1; (-) strand; PAM type: YTN; PAM sequence: TTT
ttaattgctttggaaaaaaa

SEQ ID NO: 13608 - DNA, 20 bp, Artificial Sequence
  Description of Artificial Sequence: Synthetic oligonucleotide
  Target: SOD1; (-) strand; PAM type: YTN; PAM sequence: TTT
tttaattgctttggaaaaaa

SEQ ID NO: 13609 - DNA, 20 bp, Artificial Sequence
  Description of Artificial Sequence: Synthetic oligonucleotide
  Target: SOD1; (-) strand; PAM type: YTN; PAM sequence: TTT
ttttaattgctttggaaaaa

SEQ ID NO: 13610 - DNA, 20 bp, Artificial Sequence
  Description of Artificial Sequence: Synthetic oligonucleotide
  Target: SOD1; (-) strand; PAM type: YTN; PAM sequence: TTG
gcagtttttttaattgcttt

SEQ ID NO: 13611 - DNA, 20 bp, Artificial Sequence
  Description of Artificial Sequence: Synthetic oligonucleotide
  Target: SOD1; (-) strand; PAM type: YTN; PAM sequence: TTT
ggcagtttttttaattgctt

SEQ ID NO: 13612 - DNA, 20 bp, Artificial Sequence
  Description of Artificial Sequence: Synthetic oligonucleotide
  Target: SOD1; (-) strand; PAM type: YTN; PAM sequence: CTT
tggcagtttttttaattgct

SEQ ID NO: 13613 - DNA, 20 bp, Artificial Sequence
  Description of Artificial Sequence: Synthetic oligonucleotide
  Target: SOD1; (-) strand; PAM type: YTN; PAM sequence: TTA
ctttggcagtttttttaatt

SEQ ID NO: 13614 - DNA, 20 bp, Artificial Sequence
  Description of Artificial Sequence: Synthetic oligonucleotide
  Target: SOD1; (-) strand; PAM type: YTN; PAM sequence: CTT
actttggcagtttttttaat

SEQ ID NO: 13615 - DNA, 20 bp, Artificial Sequence
  Description of Artificial Sequence: Synthetic oligonucleotide
  Target: SOD1; (-) strand; PAM type: YTN; PAM sequence: CTC
ttactttggcagttttttta

SEQ ID NO: 13616 - DNA, 20 bp, Artificial Sequence
  Description of Artificial Sequence: Synthetic oligonucleotide
  Target: SOD1; (-) strand; PAM type: YTN; PAM sequence: TTC
cgcagtcactcttactttgg

SEQ ID NO: 13617 - DNA, 20 bp, Artificial Sequence
  Description of Artificial Sequence: Synthetic oligonucleotide
  Target: SOD1; (-) strand; PAM type: YTN; PAM sequence: TTA
gttccgcagtcactcttact

SEQ ID NO: 13618 - DNA, 20 bp, Artificial Sequence
  Description of Artificial Sequence: Synthetic oligonucleotide
  Target: SOD1; (-) strand; PAM type: YTN; PAM sequence: CTT
agttccgcagtcactcttac

SEQ ID NO: 13619 - DNA, 20 bp, Artificial Sequence
  Description of Artificial Sequence: Synthetic oligonucleotide
  Target: SOD1; (-) strand; PAM type: YTN; PAM sequence: TTA
cagtaaccttagttccgcag

SEQ ID NO: 13620 - DNA, 20 bp, Artificial Sequence
  Description of Artificial Sequence: Synthetic oligonucleotide
  Target: SOD1; (-) strand; PAM type: YTN; PAM sequence: CTC
catggtaagttacagtaacc

SEQ ID NO: 13621 - DNA, 20 bp, Artificial Sequence
  Description of Artificial Sequence: Synthetic oligonucleotide
  Target: SOD1; (-) strand; PAM type: YTN; PAM sequence: TTA
atcctccatggtaagttaca

SEQ ID NO: 13622 - DNA, 20 bp, Artificial Sequence
  Description of Artificial Sequence: Synthetic oligonucleotide
  Target: SOD1; (-) strand; PAM type: YTN; PAM sequence: CTT
aatcctccatggtaagttac

SEQ ID NO: 13623 - DNA, 20 bp, Artificial Sequence
  Description of Artificial Sequence: Synthetic oligonucleotide
  Target: SOD1; (-) strand; PAM type: YTN; PAM sequence: CTA
cccttaatcctccatggtaa

SEQ ID NO: 13624 - DNA, 20 bp, Artificial Sequence
  Description of Artificial Sequence: Synthetic oligonucleotide
  Target: SOD1; (-) strand; PAM type: YTN; PAM sequence: TTG
tagaccaccacacgctaccc

SEQ ID NO: 13625 - DNA, 20 bp, Artificial Sequence
  Description of Artificial Sequence: Synthetic oligonucleotide
  Target: SOD1; (-) strand; PAM type: YTN; PAM sequence: CTA
tgttgtagaccaccacacgc

SEQ ID NO: 13626 - DNA, 20 bp, Artificial Sequence
  Description of Artificial Sequence: Synthetic oligonucleotide
  Target: SOD1; (-) strand; PAM type: YTN; PAM sequence: CTA
aaacccaaataactatgttg

SEQ ID NO: 13627 - DNA, 20 bp, Artificial Sequence
  Description of Artificial Sequence: Synthetic oligonucleotide
  Target: SOD1; (-) strand; PAM type: YTN; PAM sequence: CTA
aatgaaatactaaaacccaa

SEQ ID NO: 13628 - DNA, 20 bp, Artificial Sequence
  Description of Artificial Sequence: Synthetic oligonucleotide
  Target: SOD1; (-) strand; PAM type: YTN; PAM sequence: CTG
tctaaatgaaatactaaaac

SEQ ID NO: 13629 - DNA, 20 bp, Artificial Sequence
  Description of Artificial Sequence: Synthetic oligonucleotide
  Target: SOD1; (-) strand; PAM type: YTN; PAM sequence: TTG
ctgtctaaatgaaatactaa

SEQ ID NO: 13630 - DNA, 20 bp, Artificial Sequence
  Description of Artificial Sequence: Synthetic oligonucleotide
  Target: SOD1; (-) strand; PAM type: YTN; PAM sequence: TTA
ggtaagtgttgctgtctaaa

SEQ ID NO: 13631 - DNA, 20 bp, Artificial Sequence
  Description of Artificial Sequence: Synthetic oligonucleotide
  Target: SOD1; (-) strand; PAM type: YTN; PAM sequence: TTA
aacattaggtaagtgttgct

SEQ ID NO: 13632 - DNA, 20 bp, Artificial Sequence
  Description of Artificial Sequence: Synthetic oligonucleotide
  Target: SOD1; (-) strand; PAM type: YTN; PAM sequence: TTT
aaacattaggtaagtgttgc

SEQ ID NO: 13633 - DNA, 20 bp, Artificial Sequence
  Description of Artificial Sequence: Synthetic oligonucleotide
  Target: SOD1; (-) strand; PAM type: YTN; PAM sequence: CTT
taaacattaggtaagtgttg

SEQ ID NO: 13634 - DNA, 20 bp, Artificial Sequence
  Description of Artificial Sequence: Synthetic oligonucleotide
  Target: SOD1; (-) strand; PAM type: YTN; PAM sequence: TTA
cctttaaacattaggtaagt

SEQ ID NO: 13635 - DNA, 20 bp, Artificial Sequence
  Description of Artificial Sequence: Synthetic oligonucleotide
  Target: SOD1; (-) strand; PAM type: YTN; PAM sequence: TTG
caaagacattacctttaaac

SEQ ID NO: 13636 - DNA, 20 bp, Artificial Sequence
  Description of Artificial Sequence: Synthetic oligonucleotide
  Target: SOD1; (-) strand; PAM type: YTN; PAM sequence: TTG
gtgttgcaaagacattacct

SEQ ID NO: 13637 - DNA, 20 bp, Artificial Sequence
  Description of Artificial Sequence: Synthetic oligonucleotide
  Target: SOD1; (-) strand; PAM type: YTN; PAM sequence: CTT
ggtgttgcaaagacattacc

SEQ ID NO: 13638 - DNA, 20 bp, Artificial Sequence
  Description of Artificial Sequence: Synthetic oligonucleotide
  Target: SOD1; (-) strand; PAM type: YTN; PAM sequence: TTC
ttggtgttgcaaagacatta

SEQ ID NO: 13639 - DNA, 20 bp, Artificial Sequence
  Description of Artificial Sequence: Synthetic oligonucleotide
  Target: SOD1; (-) strand; PAM type: YTN; PAM sequence: TTT
cttggtgttgcaaagacatt

SEQ ID NO: 13640 - DNA, 20 bp, Artificial Sequence
  Description of Artificial Sequence: Synthetic oligonucleotide
  Target: SOD1; (-) strand; PAM type: YTN; PAM sequence: TTT
tcttggtgttgcaaagacat

SEQ ID NO: 13641 - DNA, 20 bp, Artificial Sequence
  Description of Artificial Sequence: Synthetic oligonucleotide
  Target: SOD1; (-) strand; PAM type: YTN; PAM sequence: TTT
ttcttggtgttgcaaagaca

SEQ ID NO: 13642 - DNA, 20 bp, Artificial Sequence
  Description of Artificial Sequence: Synthetic oligonucleotide
  Target: SOD1; (-) strand; PAM type: YTN; PAM sequence: CTT
tttcttggtgttgcaaagac

SEQ ID NO: 13643 - DNA, 20 bp, Artificial Sequence
  Description of Artificial Sequence: Synthetic oligonucleotide
  Target: SOD1; (-) strand; PAM type: YTN; PAM sequence: CTC
aaagctttttcttggtgttg

SEQ ID NO: 13644 - DNA, 20 bp, Artificial Sequence
  Description of Artificial Sequence: Synthetic oligonucleotide
  Target: SOD1; (-) strand; PAM type: YTN; PAM sequence: CTA
ctcaaagctttttcttggtg

SEQ ID NO: 13645 - DNA, 20 bp, Artificial Sequence
  Description of Artificial Sequence: Synthetic oligonucleotide
  Target: SOD1; (-) strand; PAM type: YTN; PAM sequence: CTA
ctactcaaagctttttcttg

SEQ ID NO: 13646 - DNA, 20 bp, Artificial Sequence
  Description of Artificial Sequence: Synthetic oligonucleotide
  Target: SOD1; (-) strand; PAM type: YTN; PAM sequence: TTA
aaagtagaaactactactca

SEQ ID NO: 13647 - DNA, 20 bp, Artificial Sequence
  Description of Artificial Sequence: Synthetic oligonucleotide
  Target: SOD1; (-) strand; PAM type: YTN; PAM sequence: TTT
aaaagtagaaactactactc

SEQ ID NO: 13648 - DNA, 20 bp, Artificial Sequence
  Description of Artificial Sequence: Synthetic oligonucleotide
  Target: SOD1; (-) strand; PAM type: YTN; PAM sequence: TTA
gtagtttaaaagtagaaact

SEQ ID NO: 13649 - DNA, 20 bp, Artificial Sequence
  Description of Artificial Sequence: Synthetic oligonucleotide
  Target: SOD1; (-) strand; PAM type: YTN; PAM sequence: TTT
agtagtttaaaagtagaaac

SEQ ID NO: 13650 - DNA, 20 bp, Artificial Sequence
  Description of Artificial Sequence: Synthetic oligonucleotide
  Target: SOD1; (-) strand; PAM type: YTN; PAM sequence: CTA
atatttagtagtttaaaagt

SEQ ID NO: 13651 - DNA, 20 bp, Artificial Sequence
  Description of Artificial Sequence: Synthetic oligonucleotide
  Target: SOD1; (-) strand; PAM type: YTN; PAM sequence: CTA
gtagagagatatactaatat

SEQ ID NO: 13652 - DNA, 20 bp, Artificial Sequence
  Description of Artificial Sequence: Synthetic oligonucleotide
  Target: SOD1; (-) strand; PAM type: YTN; PAM sequence: TTA
atcctagtagagagatatac

SEQ ID NO: 13653 - DNA, 20 bp, Artificial Sequence
  Description of Artificial Sequence: Synthetic oligonucleotide
  Target: SOD1; (-) strand; PAM type: YTN; PAM sequence: TTA
gaaaaataacattaatccta

SEQ ID NO: 13654 - DNA, 20 bp, Artificial Sequence
  Description of Artificial Sequence: Synthetic oligonucleotide
  Target: SOD1; (-) strand; PAM type: YTN; PAM sequence: CTC
ataatattagaaaaataaca

SEQ ID NO: 13655 - DNA, 20 bp, Artificial Sequence
  Description of Artificial Sequence: Synthetic oligonucleotide
  Target: SOD1; (-) strand; PAM type: YTN; PAM sequence: TTA
agaacctcataatattagaa

SEQ ID NO: 13656 - DNA, 20 bp, Artificial Sequence
  Description of Artificial Sequence: Synthetic oligonucleotide
  Target: SOD1; (-) strand; PAM type: YTN; PAM sequence: TTT
aagaacctcataatattaga

SEQ ID NO: 13657 - DNA, 20 bp, Artificial Sequence
  Description of Artificial Sequence: Synthetic oligonucleotide
  Target: SOD1; (-) strand; PAM type: YTN; PAM sequence: CTC
ccaacaatacccaaaagatg

SEQ ID NO: 13658 - DNA, 20 bp, Artificial Sequence
  Description of Artificial Sequence: Synthetic oligonucleotide
  Target: SOD1; (-) strand; PAM type: YTN; PAM sequence: CTC
ctcccaacaatacccaaaag

SEQ ID NO: 13659 - DNA, 20 bp, Artificial Sequence
  Description of Artificial Sequence: Synthetic oligonucleotide
  Target: SOD1; (-) strand; PAM type: YTN; PAM sequence: CTA
cctcctcccaacaataccca

SEQ ID NO: 13660 - DNA, 20 bp, Artificial Sequence
  Description of Artificial Sequence: Synthetic oligonucleotide
  Target: SOD1; (-) strand; PAM type: YTN; PAM sequence: CTG
tcaagtaatcactacctcct

SEQ ID NO: 13661 - DNA, 20 bp, Artificial Sequence
  Description of Artificial Sequence: Synthetic oligonucleotide
  Target: SOD1; (-) strand; PAM type: YTN; PAM sequence: TTG
ggctgtcaagtaatcactac

SEQ ID NO: 13662 - DNA, 20 bp, Artificial Sequence
  Description of Artificial Sequence: Synthetic oligonucleotide
  Target: SOD1; (-) strand; PAM type: YTN; PAM sequence: TTT
gggctgtcaagtaatcacta

SEQ ID NO: 13663 - DNA, 20 bp, Artificial Sequence
  Description of Artificial Sequence: Synthetic oligonucleotide
  Target: SOD1; (-) strand; PAM type: YTN; PAM sequence: CTT
tgggctgtcaagtaatcact

SEQ ID NO: 13664 - DNA, 20 bp, Artificial Sequence
  Description of Artificial Sequence: Synthetic oligonucleotide
  Target: SOD1; (-) strand; PAM type: YTN; PAM sequence: TTA
agaagataactttgggctgt

SEQ ID NO: 13665 - DNA, 20 bp, Artificial Sequence
  Description of Artificial Sequence: Synthetic oligonucleotide
  Target: SOD1; (-) strand; PAM type: YTN; PAM sequence: TTT
aagaagataactttgggctg

SEQ ID NO: 13666 - DNA, 20 bp, Artificial Sequence
  Description of Artificial Sequence: Synthetic oligonucleotide
  Target: SOD1; (-) strand; PAM type: YTN; PAM sequence: TTT
taagaagataactttgggct

SEQ ID NO: 13667 - DNA, 20 bp, Artificial Sequence
  Description of Artificial Sequence: Synthetic oligonucleotide
  Target: SOD1; (-) strand; PAM type: YTN; PAM sequence: CTG
taaaaaattttaagaagata

SEQ ID NO: 13668 - DNA, 20 bp, Artificial Sequence
  Description of Artificial Sequence: Synthetic oligonucleotide
  Target: SOD1; (-) strand; PAM type: YTN; PAM sequence: TTC
atggacctgtaaaaaatttt

SEQ ID NO: 13669 - DNA, 20 bp, Artificial Sequence
  Description of Artificial Sequence: Synthetic oligonucleotide
  Target: SOD1; (-) strand; PAM type: YTN; PAM sequence: TTT
catggacctgtaaaaaattt

SEQ ID NO: 13670 - DNA, 20 bp, Artificial Sequence
  Description of Artificial Sequence: Synthetic oligonucleotide
  Target: SOD1; (-) strand; PAM type: YTN; PAM sequence: TTT
tcatggacctgtaaaaaatt

SEQ ID NO: 13671 - DNA, 20 bp, Artificial Sequence
  Description of Artificial Sequence: Synthetic oligonucleotide
  Target: SOD1; (-) strand; PAM type: YTN; PAM sequence: TTT
ttcatggacctgtaaaaaat

SEQ ID NO: 13672 - DNA, 20 bp, Artificial Sequence
  Description of Artificial Sequence: Synthetic oligonucleotide
  Target: SOD1; (-) strand; PAM type: YTN; PAM sequence: CTT
tttcatggacctgtaaaaaa

SEQ ID NO: 13673 - DNA, 20 bp, Artificial Sequence
  Description of Artificial Sequence: Synthetic oligonucleotide
  Target: SOD1; (-) strand; PAM type: YTN; PAM sequence: CTG
ctttttcatggacctgtaaa

SEQ ID NO: 13674 - DNA, 20 bp, Artificial Sequence
  Description of Artificial Sequence: Synthetic oligonucleotide
  Target: SOD1; (-) strand; PAM type: YTN; PAM sequence: TTG
cccaagtcatctgctttttc

SEQ ID NO: 13675 - DNA, 20 bp, Artificial Sequence
  Description of Artificial Sequence: Synthetic oligonucleotide
  Target: SOD1; (-) strand; PAM type: YTN; PAM sequence: TTT
gcccaagtcatctgcttttt

SEQ ID NO: 13676 - DNA, 20 bp, Artificial Sequence
  Description of Artificial Sequence: Synthetic oligonucleotide
  Target: SOD1; (-) strand; PAM type: YTN; PAM sequence: CTT
tgcccaagtcatctgctttt

SEQ ID NO: 13677 - DNA, 20 bp, Artificial Sequence
  Description of Artificial Sequence: Synthetic oligonucleotide
  Target: SOD1; (-) strand; PAM type: YTN; PAM sequence: TTC
cacctttgcccaagtcatct

SEQ ID NO: 13678 - DNA, 20 bp, Artificial Sequence
  Description of Artificial Sequence: Synthetic oligonucleotide
  Target: SOD1; (-) strand; PAM type: YTN; PAM sequence: TTT
ccacctttgcccaagtcatc

SEQ ID NO: 13679 - DNA, 20 bp, Artificial Sequence
  Description of Artificial Sequence: Synthetic oligonucleotide
  Target: SOD1; (-) strand; PAM type: YTN; PAM sequence: TTC
atttccacctttgcccaagt

SEQ ID NO: 13680 - DNA, 20 bp, Artificial Sequence
  Description of Artificial Sequence: Synthetic oligonucleotide
  Target: SOD1; (-) strand; PAM type: YTN; PAM sequence: CTT
catttccacctttgcccaag

SEQ ID NO: 13681 - DNA, 20 bp, Artificial Sequence
  Description of Artificial Sequence: Synthetic oligonucleotide
  Target: SOD1; (-) strand; PAM type: YTN; PAM sequence: TTC
ttcatttccacctttgccca

SEQ ID NO: 13682 - DNA, 20 bp, Artificial Sequence
  Description of Artificial Sequence: Synthetic oligonucleotide
  Target: SOD1; (-) strand; PAM type: YTN; PAM sequence: TTT
cttcatttccacctttgccc

SEQ ID NO: 13683 - DNA, 20 bp, Artificial Sequence
  Description of Artificial Sequence: Synthetic oligonucleotide
  Target: SOD1; (-) strand; PAM type: YTN; PAM sequence: CTT
tcttcatttccacctttgcc

SEQ ID NO: 13684 - DNA, 20 bp, Artificial Sequence
  Description of Artificial Sequence: Synthetic oligonucleotide
  Target: SOD1; (-) strand; PAM type: YTN; PAM sequence: TTG
tactttcttcatttccacct

SEQ ID NO: 13685 - DNA, 20 bp, Artificial Sequence
  Description of Artificial Sequence: Synthetic oligonucleotide
  Target: SOD1; (-) strand; PAM type: YTN; PAM sequence: TTT
gtactttcttcatttccacc

SEQ ID NO: 13686 - DNA, 20 bp, Artificial Sequence
  Description of Artificial Sequence: Synthetic oligonucleotide
  Target: SOD1; (-) strand; PAM type: YTN; PAM sequence: CTT
tgtactttcttcatttccac

SEQ ID NO: 13687 - DNA, 20 bp, Artificial Sequence
  Description of Artificial Sequence: Synthetic oligonucleotide
  Target: SOD1; (-) strand; PAM type: YTN; PAM sequence: CTG
tctttgtactttcttcattt

SEQ ID NO: 13688 - DNA, 20 bp, Artificial Sequence
  Description of Artificial Sequence: Synthetic oligonucleotide
  Target: SOD1; (-) strand; PAM type: YTN; PAM sequence: TTC
ctgtctttgtactttcttca

SEQ ID NO: 13689 - DNA, 20 bp, Artificial Sequence
  Description of Artificial Sequence: Synthetic oligonucleotide
  Target: SOD1; (-) strand; PAM type: YTN; PAM sequence: TTT
cctgtctttgtactttcttc

SEQ ID NO: 13690 - DNA, 20 bp, Artificial Sequence
  Description of Artificial Sequence: Synthetic oligonucleotide
  Target: SOD1; (-) strand; PAM type: YTN; PAM sequence: TTC
cagcgtttcctgtctttgta

SEQ ID NO: 13691 - DNA, 20 bp, Artificial Sequence
  Description of Artificial Sequence: Synthetic oligonucleotide
  Target: SOD1; (-) strand; PAM type: YTN; PAM sequence: CTT
ccagcgtttcctgtctttgt

SEQ ID NO: 13692 - DNA, 20 bp, Artificial Sequence
  Description of Artificial Sequence: Synthetic oligonucleotide
  Target: SOD1; (-) strand; PAM type: YTN; PAM sequence: TTA
caccacaagccaaacgactt

SEQ ID NO: 13693 - DNA, 20 bp, Artificial Sequence
  Description of Artificial Sequence: Synthetic oligonucleotide
  Target: SOD1; (-) strand; PAM type: YTN; PAM sequence: TTG
ggcgatcccaattacaccac

SEQ ID NO: 13694 - DNA, 20 bp, Artificial Sequence
  Description of Artificial Sequence: Synthetic oligonucleotide
  Target: SOD1; (-) strand; PAM type: YTN; PAM sequence: TTA
ttgggcgatcccaattacac

SEQ ID NO: 13695 - DNA, 20 bp, Artificial Sequence
  Description of Artificial Sequence: Synthetic oligonucleotide
  Target: SOD1; (-) strand; PAM type: YTN; PAM sequence: TTT
attgggcgatcccaattaca

SEQ ID NO: 13696 - DNA, 20 bp, Artificial Sequence
  Description of Artificial Sequence: Synthetic oligonucleotide
  Target: SOD1; (-) strand; PAM type: YTN; PAM sequence: CTA
catccaagggaatgtttatt

SEQ ID NO: 13697 - DNA, 20 bp, Artificial Sequence
  Description of Artificial Sequence: Synthetic oligonucleotide
  Target: SOD1; (-) strand; PAM type: YTN; PAM sequence: CTC
agactacatccaagggaatg

SEQ ID NO: 13698 - DNA, 20 bp, Artificial Sequence
  Description of Artificial Sequence: Synthetic oligonucleotide
  Target: SOD1; (-) strand; PAM type: YTN; PAM sequence: TTA
aggggcctcagactacatcc

SEQ ID NO: 13699 - DNA, 20 bp, Artificial Sequence
  Description of Artificial Sequence: Synthetic oligonucleotide
  Target: SOD1; (-) strand; PAM type: YTN; PAM sequence: CTA
gcaggataacagatgagtta

SEQ ID NO: 13700 - DNA, 20 bp, Artificial Sequence
  Description of Artificial Sequence: Synthetic oligonucleotide
  Target: SOD1; (-) strand; PAM type: YTN; PAM sequence: CTA
cagctagcaggataacagat

SEQ ID NO: 13701 - DNA, 20 bp, Artificial Sequence
  Description of Artificial Sequence: Synthetic oligonucleotide
  Target: SOD1; (-) strand; PAM type: YTN; PAM sequence: TTC
tacagctagcaggataacag

SEQ ID NO: 13702 - DNA, 20 bp, Artificial Sequence
  Description of Artificial Sequence: Synthetic oligonucleotide
  Target: SOD1; (-) strand; PAM type: YTN; PAM sequence: TTT
ctacagctagcaggataaca

SEQ ID NO: 13703 - DNA, 20 bp, Artificial Sequence
  Description of Artificial Sequence: Synthetic oligonucleotide
  Target: SOD1; (-) strand; PAM type: YTN; PAM sequence: TTA
tcaggatacatttctacagc

SEQ ID NO: 13704 - DNA, 20 bp, Artificial Sequence
  Description of Artificial Sequence: Synthetic oligonucleotide
  Target: SOD1; (-) strand; PAM type: YTN; PAM sequence: TTT
atcaggatacatttctacag

SEQ ID NO: 13705 - DNA, 20 bp, Artificial Sequence
  Description of Artificial Sequence: Synthetic oligonucleotide
  Target: SOD1; (-) strand; PAM type: YTN; PAM sequence: TTA
atgtttatcaggatacattt

SEQ ID NO: 13706 - DNA, 20 bp, Artificial Sequence
  Description of Artificial Sequence: Synthetic oligonucleotide
  Target: SOD1; (-) strand; PAM type: YTN; PAM sequence: TTT
aatgtttatcaggatacatt

SEQ ID NO: 13707 - DNA, 20 bp, Artificial Sequence
  Description of Artificial Sequence: Synthetic oligonucleotide
  Target: SOD1; (-) strand; PAM type: YTN; PAM sequence: TTA
cagtgtttaatgtttatcag

SEQ ID NO: 13708 - DNA, 20 bp, Artificial Sequence
  Description of Artificial Sequence: Synthetic oligonucleotide
  Target: SOD1; (-) strand; PAM type: YTN; PAM sequence: TTA
agattacagtgtttaatgtt

SEQ ID NO: 13709 - DNA, 20 bp, Artificial Sequence
  Description of Artificial Sequence: Synthetic oligonucleotide
  Target: SOD1; (-) strand; PAM type: YTN; PAM sequence: TTT
aagattacagtgtttaatgt

SEQ ID NO: 13710 - DNA, 20 bp, Artificial Sequence
  Description of Artificial Sequence: Synthetic oligonucleotide
  Target: SOD1; (-) strand; PAM type: YTN; PAM sequence: TTT
taagattacagtgtttaatg

SEQ ID NO: 13711 - DNA, 20 bp, Artificial Sequence
  Description of Artificial Sequence: Synthetic oligonucleotide
  Target: SOD1; (-) strand; PAM type: YTN; PAM sequence: CTT
ttaagattacagtgtttaat

SEQ ID NO: 13712 - DNA, 20 bp, Artificial Sequence
  Description of Artificial Sequence: Synthetic oligonucleotide
  Target: SOD1; (-) strand; PAM type: YTN; PAM sequence: TTA
cacttttaagattacagtgt

SEQ ID NO: 13713 - DNA, 20 bp, Artificial Sequence
  Description of Artificial Sequence: Synthetic oligonucleotide
  Target: SOD1; (-) strand; PAM type: YTN; PAM sequence: CTG
aaaaagtcacacaattacac

SEQ ID NO: 13714 - DNA, 20 bp, Artificial Sequence
  Description of Artificial Sequence: Synthetic oligonucleotide
  Target: SOD1; (-) strand; PAM type: YTN; PAM sequence: CTC
tgaaaaagtcacacaattac

SEQ ID NO: 13715 - DNA, 20 bp, Artificial Sequence
  Description of Artificial Sequence: Synthetic oligonucleotide
  Target: SOD1; (-) strand; PAM type: YTN; PAM sequence: TTA
aagcaactctgaaaaagtca

SEQ ID NO: 13716 - DNA, 20 bp, Artificial Sequence
  Description of Artificial Sequence: Synthetic oligonucleotide
  Target: SOD1; (-) strand; PAM type: YTN; PAM sequence: TTT
aaagcaactctgaaaaagtc

SEQ ID NO: 13717 - DNA, 20 bp, Artificial Sequence
  Description of Artificial Sequence: Synthetic oligonucleotide
  Target: SOD1; (-) strand; PAM type: YTN; PAM sequence: CTT
taaagcaactctgaaaaagt

SEQ ID NO: 13718 - DNA, 20 bp, Artificial Sequence
  Description of Artificial Sequence: Synthetic oligonucleotide
  Target: SOD1; (-) strand; PAM type: YTN; PAM sequence: CTA
caggtactttaaagcaactc

SEQ ID NO: 13719 - DNA, 20 bp, Artificial Sequence
  Description of Artificial Sequence: Synthetic oligonucleotide
  Target: SOD1; (-) strand; PAM type: YTN; PAM sequence: CTC
actacaggtactttaaagca

SEQ ID NO: 13720 - DNA, 20 bp, Artificial Sequence
  Description of Artificial Sequence: Synthetic oligonucleotide
  Target: SOD1; (-) strand; PAM type: YTN; PAM sequence: TTC
tcactacaggtactttaaag

SEQ ID NO: 13721 - DNA, 20 bp, Artificial Sequence
  Description of Artificial Sequence: Synthetic oligonucleotide
  Target: SOD1; (-) strand; PAM type: YTN; PAM sequence: TTT
ctcactacaggtactttaaa

SEQ ID NO: 13722 - DNA, 20 bp, Artificial Sequence
  Description of Artificial Sequence: Synthetic oligonucleotide
  Target: SOD1; (-) strand; PAM type: YTN; PAM sequence: TTC
caagtgatcataaatcagtt

SEQ ID NO: 13723 - DNA, 20 bp, Artificial Sequence
  Description of Artificial Sequence: Synthetic oligonucleotide
  Target: SOD1; (-) strand; PAM type: YTN; PAM sequence: CTT
ccaagtgatcataaatcagt

SEQ ID NO: 13724 - DNA, 20 bp, Artificial Sequence
  Description of Artificial Sequence: Synthetic oligonucleotide
  Target: SOD1; (-) strand; PAM type: YTN; PAM sequence: CTA
tacaaatcttccaagtgatc

SEQ ID NO: 13725 - DNA, 20 bp, Artificial Sequence
  Description of Artificial Sequence: Synthetic oligonucleotide
  Target: SOD1; (-) strand; PAM type: YTN; PAM sequence: TTA
taaaactatacaaatcttcc

SEQ ID NO: 13726 - DNA, 20 bp, Artificial Sequence
  Description of Artificial Sequence: Synthetic oligonucleotide
  Target: SOD1; (-) strand; PAM type: YTN; PAM sequence: TTT
ataaaactatacaaatcttc

SEQ ID NO: 13727 - DNA, 20 bp, Artificial Sequence
  Description of Artificial Sequence: Synthetic oligonucleotide
  Target: SOD1; (-) strand; PAM type: YTN; PAM sequence: TTT
tataaaactatacaaatctt

SEQ ID NO: 13728 - DNA, 20 bp, Artificial Sequence
  Description of Artificial Sequence: Synthetic oligonucleotide
  Target: SOD1; (-) strand; PAM type: YTN; PAM sequence: CTG
agttttataaaactatacaa

SEQ ID NO: 13729 - DNA, 20 bp, Artificial Sequence
  Description of Artificial Sequence: Synthetic oligonucleotide
  Target: SOD1; (-) strand; PAM type: YTN; PAM sequence: TTA
actgagttttataaaactat

SEQ ID NO: 13730 - DNA, 20 bp, Artificial Sequence
  Description of Artificial Sequence: Synthetic oligonucleotide
  Target: SOD1; (-) strand; PAM type: YTN; PAM sequence: TTT
aactgagttttataaaacta

SEQ ID NO: 13731 - DNA, 20 bp, Artificial Sequence
  Description of Artificial Sequence: Synthetic oligonucleotide
  Target: SOD1; (-) strand; PAM type: YTN; PAM sequence: TTT
taactgagttttataaaact

SEQ ID NO: 13732 - DNA, 20 bp, Artificial Sequence
  Description of Artificial Sequence: Synthetic oligonucleotide
  Target: SOD1; (-) strand; PAM type: YTN; PAM sequence: TTG
aaacagacattttaactgag

SEQ ID NO: 13733 - DNA, 20 bp, Artificial Sequence
  Description of Artificial Sequence: Synthetic oligonucleotide
  Target: SOD1; (-) strand; PAM type: YTN; PAM sequence: CTG
gcaaaatacaggtcattgaa

SEQ ID NO: 13734 - DNA, 20 bp, Artificial Sequence
  Description of Artificial Sequence: Synthetic oligonucleotide
  Target: SOD1; (-) strand; PAM type: YTN; PAM sequence: TTA
agtctggcaaaatacaggtc

SEQ ID NO: 13735 - DNA, 20 bp, Artificial Sequence
  Description of Artificial Sequence: Synthetic oligonucleotide
  Target: SOD1; (-) strand; PAM type: YTN; PAM sequence: TTT
aagtctggcaaaatacaggt

SEQ ID NO: 13736 - DNA, 20 bp, Artificial Sequence
  Description of Artificial Sequence: Synthetic oligonucleotide
  Target: SOD1; (-) strand; PAM type: YTN; PAM sequence: CTG
tgatttaagtctggcaaaat

SEQ ID NO: 13737 - DNA, 20 bp, Artificial Sequence
  Description of Artificial Sequence: Synthetic oligonucleotide
  Target: SOD1; (-) strand; PAM type: YTN; PAM sequence: TTA
atacccatctgtgatttaag

SEQ ID NO: 13738 - DNA, 20 bp, Artificial Sequence
  Description of Artificial Sequence: Synthetic oligonucleotide
  Target: SOD1; (-) strand; PAM type: YTN; PAM sequence: TTT
aatacccatctgtgatttaa

SEQ ID NO: 13739 - DNA, 20 bp, Artificial Sequence
  Description of Artificial Sequence: Synthetic oligonucleotide
  Target: SOD1; (-) strand; PAM type: YTN; PAM sequence: CTG
acaagtttaatacccatctg

SEQ ID NO: 13740 - DNA, 20 bp, Artificial Sequence
  Description of Artificial Sequence: Synthetic oligonucleotide
  Target: SOD1; (-) strand; PAM type: YTN; PAM sequence: TTC
tgacaagtttaatacccatc

SEQ ID NO: 13741 - DNA, 20 bp, Artificial Sequence
  Description of Artificial Sequence: Synthetic oligonucleotide
  Target: SOD1; (-) strand; PAM type: YTN; PAM sequence: TTG
aatgacaaagaaattctgac

SEQ ID NO: 13742 - DNA, 20 bp, Artificial Sequence
  Description of Artificial Sequence: Synthetic oligonucleotide
  Target: SOD1; (-) strand; PAM type: YTN; PAM sequence: CTT
gaatgacaaagaaattctga

SEQ ID NO: 13743 - DNA, 20 bp, Artificial Sequence
  Description of Artificial Sequence: Synthetic oligonucleotide
  Target: SOD1; (-) strand; PAM type: YTN; PAM sequence: TTC
acaggcttgaatgacaaaga

SEQ ID NO: 13744 - DNA, 20 bp, Artificial Sequence
  Description of Artificial Sequence: Synthetic oligonucleotide
  Target: SOD1; (-) strand; PAM type: YTN; PAM sequence: TTA
ttcacaggcttgaatgacaa

SEQ ID NO: 13745 - DNA, 20 bp, Artificial Sequence
  Description of Artificial Sequence: Synthetic oligonucleotide
  Target: SOD1; (-) strand; PAM type: YTN; PAM sequence: TTT
attcacaggcttgaatgaca

SEQ ID NO: 13746 - DNA, 20 bp, Artificial Sequence
  Description of Artificial Sequence: Synthetic oligonucleotide
  Target: SOD1; (-) strand; PAM type: YTN; PAM sequence: TTT
tattcacaggcttgaatgac

SEQ ID NO: 13747 - DNA, 20 bp, Artificial Sequence
  Description of Artificial Sequence: Synthetic oligonucleotide
  Target: SOD1; (-) strand; PAM type: YTN; PAM sequence: TTT
ttattcacaggcttgaatga

SEQ ID NO: 13748 - DNA, 20 bp, Artificial Sequence
  Description of Artificial Sequence: Synthetic oligonucleotide
  Target: SOD1; (-) strand; PAM type: YTN; PAM sequence: CTC
ataataagtgccatacaggg

SEQ ID NO: 13749 - DNA, 20 bp, Artificial Sequence
  Description of Artificial Sequence: Synthetic oligonucleotide
  Target: SOD1; (-) strand; PAM type: YTN; PAM sequence: TTA
atagcctcataataagtgcc

SEQ ID NO: 13750 - DNA, 20 bp, Artificial Sequence
  Description of Artificial Sequence: Synthetic oligonucleotide
  Target: SOD1; (-) strand; PAM type: YTN; PAM sequence: TTT
aatagcctcataataagtgc

SEQ ID NO: 13751 - DNA, 20 bp, Artificial Sequence
  Description of Artificial Sequence: Synthetic oligonucleotide
  Target: SOD1; (-) strand; PAM type: YTN; PAM sequence: TTT
taatagcctcataataagtg

SEQ ID NO: 13752 - DNA, 20 bp, Artificial Sequence
  Description of Artificial Sequence: Synthetic oligonucleotide
  Target: SOD1; (-) strand; PAM type: YTN; PAM sequence: CTT
ttaatagcctcataataagt

SEQ ID NO: 13753 - DNA, 20 bp, Artificial Sequence
  Description of Artificial Sequence: Synthetic oligonucleotide
  Target: SOD1; (-) strand; PAM type: YTN; PAM sequence: TTC
ttttaatagcctcataataa

SEQ ID NO: 13754 - DNA, 20 bp, Artificial Sequence
  Description of Artificial Sequence: Synthetic oligonucleotide
  Target: SOD1; (-) strand; PAM type: YTN; PAM sequence: TTG
gattcttttaatagcctcat

SEQ ID NO: 13755 - DNA, 20 bp, Artificial Sequence
  Description of Artificial Sequence: Synthetic oligonucleotide
  Target: SOD1; (-) strand; PAM type: YTN; PAM sequence: TTT
ggattcttttaatagcctca

SEQ ID NO: 13756 - DNA, 20 bp, Artificial Sequence
  Description of Artificial Sequence: Synthetic oligonucleotide
  Target: SOD1; (-) strand; PAM type: YTN; PAM sequence: TTG
aatttggattcttttaatag

SEQ ID NO: 13757 - DNA, 20 bp, Artificial Sequence
  Description of Artificial Sequence: Synthetic oligonucleotide
  Target: SOD1; (-) strand; PAM type: YTN; PAM sequence: TTT
gaatttggattcttttaata

SEQ ID NO: 13758 - DNA, 20 bp, Artificial Sequence
  Description of Artificial Sequence: Synthetic oligonucleotide
  Target: SOD1; (-) strand; PAM type: YTN; PAM sequence: TTA
gtttgaatttggattctttt

SEQ ID NO: 13759 - DNA, 20 bp, Artificial Sequence
  Description of Artificial Sequence: Synthetic oligonucleotide
  Target: SOD1; (-) strand; PAM type: YTN; PAM sequence: TTT
agtttgaatttggattcttt

SEQ ID NO: 13760 - DNA, 20 bp, Artificial Sequence
  Description of Artificial Sequence: Synthetic oligonucleotide
  Target: SOD1; (-) strand; PAM type: YTN; PAM sequence: CTA
atttagtttgaatttggatt

SEQ ID NO: 13761 - DNA, 20 bp, Artificial Sequence
  Description of Artificial Sequence: Synthetic oligonucleotide
  Target: SOD1; (-) strand; PAM type: YTN; PAM sequence: TTA
tataaataagtatcagagct

SEQ ID NO: 13762 - DNA, 20 bp, Artificial Sequence
  Description of Artificial Sequence: Synthetic oligonucleotide
  Target: SOD1; (-) strand; PAM type: YTN; PAM sequence: TTT
atataaataagtatcagagc

SEQ ID NO: 13763 - DNA, 20 bp, Artificial Sequence
  Description of Artificial Sequence: Synthetic oligonucleotide
  Target: SOD1; (-) strand; PAM type: YTN; PAM sequence: CTG
tttatataaataagtatcag

SEQ ID NO: 13764 - DNA, 20 bp, Artificial Sequence
  Description of Artificial Sequence: Synthetic oligonucleotide
  Target: SOD1; (-) strand; PAM type: YTN; PAM sequence: CTG
aagctgtttatataaataag

SEQ ID NO: 13765 - DNA, 20 bp, Artificial Sequence
  Description of Artificial Sequence: Synthetic oligonucleotide
  Target: SOD1; (-) strand; PAM type: YTN; PAM sequence: TTC
cactgaagctgtttatataa

SEQ ID NO: 13766 - DNA, 20 bp, Artificial Sequence
  Description of Artificial Sequence: Synthetic oligonucleotide
  Target: SOD1; (-) strand; PAM type: YTN; PAM sequence: CTG
ttccactgaagctgtttata

SEQ ID NO: 13767 - DNA, 20 bp, Artificial Sequence
  Description of Artificial Sequence: Synthetic oligonucleotide
  Target: SOD1; (-) strand; PAM type: YTN; PAM sequence: CTA
aatctgttccactgaagctg

SEQ ID NO: 13768 - DNA, 20 bp, Artificial Sequence
  Description of Artificial Sequence: Synthetic oligonucleotide
  Target: SOD1; (-) strand; PAM type: YTN; PAM sequence: TTA
ctaaatctgttccactgaag

SEQ ID NO: 13769 - DNA, 20 bp, Artificial Sequence
  Description of Artificial Sequence: Synthetic oligonucleotide
  Target: SOD1; (-) strand; PAM type: YTN; PAM sequence: TTA
gtattactaaatctgttcca

SEQ ID NO: 13770 - DNA, 20 bp, Artificial Sequence
  Description of Artificial Sequence: Synthetic oligonucleotide
  Target: SOD1; (-) strand; PAM type: YTN; PAM sequence: CTG
ttagtattactaaatctgtt

SEQ ID NO: 13771 - DNA, 20 bp, Artificial Sequence
  Description of Artificial Sequence: Synthetic oligonucleotide
  Target: SOD1; (-) strand; PAM type: YTN; PAM sequence: CTA
tcactgttagtattactaaa

SEQ ID NO: 13772 - DNA, 20 bp, Artificial Sequence
  Description of Artificial Sequence: Synthetic oligonucleotide
  Target: SOD1; (-) strand; PAM type: YTN; PAM sequence: TTC
aaaataaaatgctatcactg

SEQ ID NO: 13773 - DNA, 20 bp, Artificial Sequence
  Description of Artificial Sequence: Synthetic oligonucleotide
  Target: SOD1; (-) strand; PAM type: YTN; PAM sequence: TTT
caaaataaaatgctatcact

SEQ ID NO: 13774 - DNA, 20 bp, Artificial Sequence
  Description of Artificial Sequence: Synthetic oligonucleotide
  Target: SOD1; (-) strand; PAM type: YTN; PAM sequence: CTT
tcaaaataaaatgctatcac

SEQ ID NO: 13775 - DNA, 20 bp, Artificial Sequence
  Description of Artificial Sequence: Synthetic oligonucleotide
  Target: SOD1; (-) strand; PAM type: YTN; PAM sequence: CTC
aaaacactttcaaaataaaa

SEQ ID NO: 13776 - DNA, 20 bp, Artificial Sequence
  Description of Artificial Sequence: Synthetic oligonucleotide
  Target: SOD1; (-) strand; PAM type: YTN; PAM sequence: TTG
atggtctcaaaacactttca

SEQ ID NO: 13777 - DNA, 20 bp, Artificial Sequence
  Description of Artificial Sequence: Synthetic oligonucleotide
  Target: SOD1; (-) strand; PAM type: YTN; PAM sequence: TTT
gatggtctcaaaacactttc

SEQ ID NO: 13778 - DNA, 20 bp, Artificial Sequence
  Description of Artificial Sequence: Synthetic oligonucleotide
  Target: SOD1; (-) strand; PAM type: YTN; PAM sequence: TTT
tgatggtctcaaaacacttt

SEQ ID NO: 13779 - DNA, 20 bp, Artificial Sequence
  Description of Artificial Sequence: Synthetic oligonucleotide
  Target: SOD1; (-) strand; PAM type: YTN; PAM sequence: TTA
aagtatgcattttgatggtc

SEQ ID NO: 13780 - DNA, 20 bp, Artificial Sequence
  Description of Artificial Sequence: Synthetic oligonucleotide
  Target: SOD1; (-) strand; PAM type: YTN; PAM sequence: TTT
aaagtatgcattttgatggt

SEQ ID NO: 13781 - DNA, 20 bp, Artificial Sequence
  Description of Artificial Sequence: Synthetic oligonucleotide
  Target: SOD1; (-) strand; PAM type: YTN; PAM sequence: TTT
taaagtatgcattttgatgg

SEQ ID NO: 13782 - DNA, 20 bp, Artificial Sequence
  Description of Artificial Sequence: Synthetic oligonucleotide
  Target: SOD1; (-) strand; PAM type: YTN; PAM sequence: CTG
ttttaaagtatgcattttga

SEQ ID NO: 13783 - DNA, 20 bp, Artificial Sequence
  Description of Artificial Sequence: Synthetic oligonucleotide
  Target: SOD1; (-) strand; PAM type: YTN; PAM sequence: CTG
ctgttttaaagtatgcattt

SEQ ID NO: 13784 - DNA, 20 bp, Artificial Sequence
  Description of Artificial Sequence: Synthetic oligonucleotide
  Target: SOD1; (-) strand; PAM type: YTN; PAM sequence: CTA
aaagacctgctgttttaaag

SEQ ID NO: 13785 - DNA, 20 bp, Artificial Sequence
  Description of Artificial Sequence: Synthetic oligonucleotide
  Target: SOD1; (-) strand; PAM type: YTN; PAM sequence: TTA
gctaaaagacctgctgtttt

SEQ ID NO: 13786 - DNA, 20 bp, Artificial Sequence
  Description of Artificial Sequence: Synthetic oligonucleotide
  Target: SOD1; (-) strand; PAM type: YTN; PAM sequence: TTT
agctaaaagacctgctgttt

SEQ ID NO: 13787 - DNA, 20 bp, Artificial Sequence
  Description of Artificial Sequence: Synthetic oligonucleotide
  Target: SOD1; (-) strand; PAM type: YTN; PAM sequence: TTT
tagctaaaagacctgctgtt

SEQ ID NO: 13788 - DNA, 20 bp, Artificial Sequence
  Description of Artificial Sequence: Synthetic oligonucleotide
  Target: SOD1; (-) strand; PAM type: YTN; PAM sequence: TTA
gttttagctaaaagacctgc

SEQ ID NO: 13789 - DNA, 20 bp, Artificial Sequence
  Description of Artificial Sequence: Synthetic oligonucleotide
  Target: SOD1; (-) strand; PAM type: YTN; PAM sequence: TTG
tgttagttttagctaaaaga

SEQ ID NO: 13790 - DNA, 20 bp, Artificial Sequence
  Description of Artificial Sequence: Synthetic oligonucleotide
  Target: SOD1; (-) strand; PAM type: YTN; PAM sequence: CTA
agcagagttgtgttagtttt

SEQ ID NO: 13791 - DNA, 20 bp, Artificial Sequence
  Description of Artificial Sequence: Synthetic oligonucleotide
  Target: SOD1; (-) strand; PAM type: YTN; PAM sequence: TTG
tctaagcagagttgtgttag

SEQ ID NO: 13792 - DNA, 20 bp, Artificial Sequence
  Description of Artificial Sequence: Synthetic oligonucleotide
  Target: SOD1; (-) strand; PAM type: YTN; PAM sequence: TTT
gtctaagcagagttgtgtta

SEQ ID NO: 13793 - DNA, 20 bp, Artificial Sequence
  Description of Artificial Sequence: Synthetic oligonucleotide
  Target: SOD1; (-) strand; PAM type: YTN; PAM sequence: CTA
tttgtctaagcagagttgtg

SEQ ID NO: 13794 - DNA, 20 bp, Artificial Sequence
  Description of Artificial Sequence: Synthetic oligonucleotide
  Target: SOD1; (-) strand; PAM type: YTN; PAM sequence: TTC
aaaggacagcctatttgtct

SEQ ID NO: 13795 - DNA, 20 bp, Artificial Sequence
  Description of Artificial Sequence: Synthetic oligonucleotide
  Target: SOD1; (-) strand; PAM type: YTN; PAM sequence: TTT
caaaggacagcctatttgtc

SEQ ID NO: 13796 - DNA, 20 bp, Artificial Sequence
  Description of Artificial Sequence: Synthetic oligonucleotide
  Target: SOD1; (-) strand; PAM type: YTN; PAM sequence: CTT
tcaaaggacagcctatttgt

SEQ ID NO: 13797 - DNA, 20 bp, Artificial Sequence
  Description of Artificial Sequence: Synthetic oligonucleotide
  Target: SOD1; (-) strand; PAM type: YTN; PAM sequence: CTA
aagctttcaaaggacagcct

SEQ ID NO: 13798 - DNA, 20 bp, Artificial Sequence
  Description of Artificial Sequence: Synthetic oligonucleotide
  Target: SOD1; (-) strand; PAM type: YTN; PAM sequence: TTC
cctaaagctttcaaaggaca

SEQ ID NO: 13799 - DNA, 20 bp, Artificial Sequence
  Description of Artificial Sequence: Synthetic oligonucleotide
  Target: SOD1; (-) strand; PAM type: YTN; PAM sequence: TTT
ccctaaagctttcaaaggac

SEQ ID NO: 13800 - DNA, 20 bp, Artificial Sequence
  Description of Artificial Sequence: Synthetic oligonucleotide
  Target: SOD1; (-) strand; PAM type: YTN; PAM sequence: CTA
agcaggaacatttccctaaa

SEQ ID NO: 13801 - DNA, 20 bp, Artificial Sequence
  Description of Artificial Sequence: Synthetic oligonucleotide
  Target: SOD1; (-) strand; PAM type: YTN; PAM sequence: CTA
aaatgactaagcaggaacat

SEQ ID NO: 13802 - DNA, 20 bp, Artificial Sequence
  Description of Artificial Sequence: Synthetic oligonucleotide
  Target: SOD1; (-) strand; PAM type: YTN; PAM sequence: TTA
tgaatcaaaatgctaaaatg

SEQ ID NO: 13803 - DNA, 20 bp, Artificial Sequence
  Description of Artificial Sequence: Synthetic oligonucleotide
  Target: SOD1; (-) strand; PAM type: YTN; PAM sequence: TTT
atgaatcaaaatgctaaaat

SEQ ID NO: 13804 - DNA, 20 bp, Artificial Sequence
  Description of Artificial Sequence: Synthetic oligonucleotide
  Target: SOD1; (-) strand; PAM type: YTN; PAM sequence: CTT
tatgaatcaaaatgctaaaa

SEQ ID NO: 13805 - DNA, 20 bp, Artificial Sequence
  Description of Artificial Sequence: Synthetic oligonucleotide
  Target: SOD1; (-) strand; PAM type: YTN; PAM sequence: TTA
aaatgaggaggtactttatg

SEQ ID NO: 13806 - DNA, 20 bp, Artificial Sequence
  Description of Artificial Sequence: Synthetic oligonucleotide
  Target: SOD1; (-) strand; PAM type: YTN; PAM sequence: TTT
aaaatgaggaggtactttat

SEQ ID NO: 13807 - DNA, 20 bp, Artificial Sequence
  Description of Artificial Sequence: Synthetic oligonucleotide
  Target: SOD1; (-) strand; PAM type: YTN; PAM sequence: TTT
taaaatgaggaggtacttta

SEQ ID NO: 13808 - DNA, 20 bp, Artificial Sequence
  Description of Artificial Sequence: Synthetic oligonucleotide
  Target: SOD1; (-) strand; PAM type: YTN; PAM sequence: TTT
ttaaaatgaggaggtacttt

SEQ ID NO: 13809 - DNA, 20 bp, Artificial Sequence
  Description of Artificial Sequence: Synthetic oligonucleotide
  Target: SOD1; (-) strand; PAM type: YTN; PAM sequence: CTT
tttaaaatgaggaggtactt

SEQ ID NO: 13810 - DNA, 20 bp, Artificial Sequence
  Description of Artificial Sequence: Synthetic oligonucleotide
  Target: SOD1; (-) strand; PAM type: YTN; PAM sequence: TTA
catcataatgtctttttaaa

SEQ ID NO: 13811 - DNA, 20 bp, Artificial Sequence
  Description of Artificial Sequence: Synthetic oligonucleotide
  Target: SOD1; (-) strand; PAM type: YTN; PAM sequence: CTT
acatcataatgtctttttaa

SEQ ID NO: 13812 - DNA, 20 bp, Artificial Sequence
  Description of Artificial Sequence: Synthetic oligonucleotide
  Target: SOD1; (-) strand; PAM type: YTN; PAM sequence: CTC
ttacatcataatgtcttttt

SEQ ID NO: 13813 - DNA, 20 bp, Artificial Sequence
  Description of Artificial Sequence: Synthetic oligonucleotide
  Target: SOD1; (-) strand; PAM type: YTN; PAM sequence: CTC
tcttacatcataatgtcttt

SEQ ID NO: 13814 - DNA, 20 bp, Artificial Sequence
  Description of Artificial Sequence: Synthetic oligonucleotide
  Target: SOD1; (-) strand; PAM type: YTN; PAM sequence: TTA
tcaaatggctctcttacatc

SEQ ID NO: 13815 - DNA, 20 bp, Artificial Sequence
  Description of Artificial Sequence: Synthetic oligonucleotide
  Target: SOD1; (-) strand; PAM type: YTN; PAM sequence: CTA
aaaagttatcaaatggctct

SEQ ID NO: 13816 - DNA, 20 bp, Artificial Sequence
  Description of Artificial Sequence: Synthetic oligonucleotide
  Target: SOD1; (-) strand; PAM type: YTN; PAM sequence: CTC
actaaaaagttatcaaatgg

SEQ ID NO: 13817 - DNA, 20 bp, Artificial Sequence
  Description of Artificial Sequence: Synthetic oligonucleotide
  Target: SOD1; (-) strand; PAM type: YTN; PAM sequence: TTC
aaagctcactaaaaagttat

SEQ ID NO: 13818 - DNA, 20 bp, Artificial Sequence
  Description of Artificial Sequence: Synthetic oligonucleotide
  Target: SOD1; (-) strand; PAM type: YTN; PAM sequence: TTT
caaagctcactaaaaagtta

SEQ ID NO: 13819 - DNA, 20 bp, Artificial Sequence
  Description of Artificial Sequence: Synthetic oligonucleotide
  Target: SOD1; (-) strand; PAM type: YTN; PAM sequence: CTT
tcaaagctcactaaaaagtt

SEQ ID NO: 13820 - DNA, 20 bp, Artificial Sequence
  Description of Artificial Sequence: Synthetic oligonucleotide
  Target: SOD1; (-) strand; PAM type: YTN; PAM sequence: TTG
cctttcaaagctcactaaaa

SEQ ID NO: 13821 - DNA, 20 bp, Artificial Sequence
  Description of Artificial Sequence: Synthetic oligonucleotide
  Target: SOD1; (-) strand; PAM type: YTN; PAM sequence: CTT
gcctttcaaagctcactaaa

SEQ ID NO: 13822 - DNA, 20 bp, Artificial Sequence
  Description of Artificial Sequence: Synthetic oligonucleotide
  Target: SOD1; (-) strand; PAM type: YTN; PAM sequence: CTG
taacttgcctttcaaagctc

SEQ ID NO: 13823 - DNA, 20 bp, Artificial Sequence
  Description of Artificial Sequence: Synthetic oligonucleotide
  Target: SOD1; (-) strand; PAM type: YTN; PAM sequence: CTG
aggctgtaacttgcctttca

SEQ ID NO: 13824 - DNA, 20 bp, Artificial Sequence
  Description of Artificial Sequence: Synthetic oligonucleotide
  Target: SOD1; (-) strand; PAM type: YTN; PAM sequence: CTA
gctgaggctgtaacttgcct

SEQ ID NO: 13825 - DNA, 20 bp, Artificial Sequence
  Description of Artificial Sequence: Synthetic oligonucleotide
  Target: SOD1; (-) strand; PAM type: YTN; PAM sequence: CTA
gctagctgaggctgtaactt

SEQ ID NO: 13826 - DNA, 20 bp, Artificial Sequence
  Description of Artificial Sequence: Synthetic oligonucleotide
  Target: SOD1; (-) strand; PAM type: YTN; PAM sequence: TTA
ctagctagctgaggctgtaa

SEQ ID NO: 13827 - DNA, 20 bp, Artificial Sequence
  Description of Artificial Sequence: Synthetic oligonucleotide
  Target: SOD1; (-) strand; PAM type: YTN; PAM sequence: CTT
actagctagctgaggctgta

SEQ ID NO: 13828 - DNA, 20 bp, Artificial Sequence
  Description of Artificial Sequence: Synthetic oligonucleotide
  Target: SOD1; (-) strand; PAM type: YTN; PAM sequence: CTG
gcaggtagataatcttacta

SEQ ID NO: 13829 - DNA, 20 bp, Artificial Sequence
  Description of Artificial Sequence: Synthetic oligonucleotide
  Target: SOD1; (-) strand; PAM type: YTN; PAM sequence: TTC
tggcaggtagataatcttac

SEQ ID NO: 13830 - DNA, 20 bp, Artificial Sequence
  Description of Artificial Sequence: Synthetic oligonucleotide
  Target: SOD1; (-) strand; PAM type: YTN; PAM sequence: TTG
tgccattctggcaggtagat

SEQ ID NO: 13831 - DNA, 20 bp, Artificial Sequence
  Description of Artificial Sequence: Synthetic oligonucleotide
  Target: SOD1; (-) strand; PAM type: YTN; PAM sequence: TTT
gtgccattctggcaggtaga

SEQ ID NO: 13832 - DNA, 20 bp, Artificial Sequence
  Description of Artificial Sequence: Synthetic oligonucleotide
  Target: SOD1; (-) strand; PAM type: YTN; PAM sequence: TTG
aatgtagaatttgtgccatt

SEQ ID NO: 13833 - DNA, 20 bp, Artificial Sequence
  Description of Artificial Sequence: Synthetic oligonucleotide
  Target: SOD1; (-) strand; PAM type: YTN; PAM sequence: CTT
gaatgtagaatttgtgccat

SEQ ID NO: 13834 - DNA, 20 bp, Artificial Sequence
  Description of Artificial Sequence: Synthetic oligonucleotide
  Target: SOD1; (-) strand; PAM type: YTN; PAM sequence: CTA
cccttgaatgtagaatttgt

SEQ ID NO: 13835 - DNA, 20 bp, Artificial Sequence
  Description of Artificial Sequence: Synthetic oligonucleotide
  Target: SOD1; (-) strand; PAM type: YTN; PAM sequence: TTG
tgccagcgtctacccttgaa

SEQ ID NO: 13836 - DNA, 20 bp, Artificial Sequence
  Description of Artificial Sequence: Synthetic oligonucleotide
  Target: SOD1; (-) strand; PAM type: YTN; PAM sequence: CTG
taagtaggttgtgccagcgt

SEQ ID NO: 13837 - DNA, 20 bp, Artificial Sequence
  Description of Artificial Sequence: Synthetic oligonucleotide
  Target: SOD1; (-) strand; PAM type: YTN; PAM sequence: CTA
atctgtaagtaggttgtgcc

SEQ ID NO: 13838 - DNA, 20 bp, Artificial Sequence
  Description of Artificial Sequence: Synthetic oligonucleotide
  Target: SOD1; (-) strand; PAM type: YTN; PAM sequence: TTA
aagggctaatctgtaagtag

SEQ ID NO: 13839 - DNA, 20 bp, Artificial Sequence
  Description of Artificial Sequence: Synthetic oligonucleotide
  Target: SOD1; (-) strand; PAM type: YTN; PAM sequence: TTT
aaagggctaatctgtaagta

SEQ ID NO: 13840 - DNA, 20 bp, Artificial Sequence
  Description of Artificial Sequence: Synthetic oligonucleotide
  Target: SOD1; (-) strand; PAM type: YTN; PAM sequence: CTT
taaagggctaatctgtaagt

SEQ ID NO: 13841 - DNA, 20 bp, Artificial Sequence
  Description of Artificial Sequence: Synthetic oligonucleotide
  Target: SOD1; (-) strand; PAM type: YTN; PAM sequence: TTG
ctttaaagggctaatctgta

SEQ ID NO: 13842 - DNA, 20 bp, Artificial Sequence
  Description of Artificial Sequence: Synthetic oligonucleotide
  Target: SOD1; (-) strand; PAM type: YTN; PAM sequence: CTA
cagattgctttaaagggcta

SEQ ID NO: 13843 - DNA, 20 bp, Artificial Sequence
  Description of Artificial Sequence: Synthetic oligonucleotide
  Target: SOD1; (-) strand; PAM type: YTN; PAM sequence: CTA
atgctacagattgctttaaa

SEQ ID NO: 13844 - DNA, 20 bp, Artificial Sequence
  Description of Artificial Sequence: Synthetic oligonucleotide
  Target: SOD1; (-) strand; PAM type: YTN; PAM sequence: TTC
taatgctacagattgcttta

SEQ ID NO: 13845 - DNA, 20 bp, Artificial Sequence
  Description of Artificial Sequence: Synthetic oligonucleotide
  Target: SOD1; (-) strand; PAM type: YTN; PAM sequence: CTT
ctaatgctacagattgcttt

SEQ ID NO: 13846 - DNA, 20 bp, Artificial Sequence
  Description of Artificial Sequence: Synthetic oligonucleotide
  Target: SOD1; (-) strand; PAM type: YTN; PAM sequence: TTC
catcttctaatgctacagat

SEQ ID NO: 13847 - DNA, 20 bp, Artificial Sequence
  Description of Artificial Sequence: Synthetic oligonucleotide
  Target: SOD1; (-) strand; PAM type: YTN; PAM sequence: TTG
gttccatcttctaatgctac

SEQ ID NO: 13848 - DNA, 20 bp, Artificial Sequence
  Description of Artificial Sequence: Synthetic oligonucleotide
  Target: SOD1; (-) strand; PAM type: YTN; PAM sequence: CTT
ggttccatcttctaatgcta

SEQ ID NO: 13849 - DNA, 20 bp, Artificial Sequence
  Description of Artificial Sequence: Synthetic oligonucleotide
  Target: SOD1; (-) strand; PAM type: YTN; PAM sequence: TTC
cttggttccatcttctaatg

SEQ ID NO: 13850 - DNA, 20 bp, Artificial Sequence
  Description of Artificial Sequence: Synthetic oligonucleotide
  Target: SOD1; (-) strand; PAM type: YTN; PAM sequence: TTT
ccttggttccatcttctaat

SEQ ID NO: 13851 - DNA, 20 bp, Artificial Sequence
  Description of Artificial Sequence: Synthetic oligonucleotide
  Target: SOD1; (-) strand; PAM type: YTN; PAM sequence: CTC
aacagccagaacccacagtc

SEQ ID NO: 13852 - DNA, 20 bp, Artificial Sequence
  Description of Artificial Sequence: Synthetic oligonucleotide
  Target: SOD1; (-) strand; PAM type: YTN; PAM sequence: TTC
tcaacagccagaacccacag

SEQ ID NO: 13853 - DNA, 20 bp, Artificial Sequence
  Description of Artificial Sequence: Synthetic oligonucleotide
  Target: SOD1; (-) strand; PAM type: YTN; PAM sequence: TTT
ctcaacagccagaacccaca

SEQ ID NO: 13854 - DNA, 20 bp, Artificial Sequence
  Description of Artificial Sequence: Synthetic oligonucleotide
  Target: SOD1; (-) strand; PAM type: YTN; PAM sequence: TTA
tttctcaacagccagaaccc

SEQ ID NO: 13855 - DNA, 20 bp, Artificial Sequence
  Description of Artificial Sequence: Synthetic oligonucleotide
  Target: SOD1; (-) strand; PAM type: YTN; PAM sequence: TTC
ggtgtgtaaattatttctca

SEQ ID NO: 13856 - DNA, 20 bp, Artificial Sequence
  Description of Artificial Sequence: Synthetic oligonucleotide
  Target: SOD1; (-) strand; PAM type: YTN; PAM sequence: CTA
attcggtgtgtaaattattt

SEQ ID NO: 13857 - DNA, 20 bp, Artificial Sequence
  Description of Artificial Sequence: Synthetic oligonucleotide
  Target: SOD1; (-) strand; PAM type: YTN; PAM sequence: TTC
actaattcggtgtgtaaatt

SEQ ID NO: 13858 - DNA, 20 bp, Artificial Sequence
  Description of Artificial Sequence: Synthetic oligonucleotide
  Target: SOD1; (-) strand; PAM type: YTN; PAM sequence: TTT
cactaattcggtgtgtaaat

SEQ ID NO: 13859 - DNA, 20 bp, Artificial Sequence
  Description of Artificial Sequence: Synthetic oligonucleotide
  Target: SOD1; (-) strand; PAM type: YTN; PAM sequence: CTC
atttcactaattcggtgtgt

SEQ ID NO: 13860 - DNA, 20 bp, Artificial Sequence
  Description of Artificial Sequence: Synthetic oligonucleotide
  Target: SOD1; (-) strand; PAM type: YTN; PAM sequence: TTA
agagaaagtgactcatttca

SEQ ID NO: 13861 - DNA, 20 bp, Artificial Sequence
  Description of Artificial Sequence: Synthetic oligonucleotide
  Target: SOD1; (-) strand; PAM type: YTN; PAM sequence: CTC
aggtacataaatacattaag

SEQ ID NO: 13862 - DNA, 20 bp, Artificial Sequence
  Description of Artificial Sequence: Synthetic oligonucleotide
  Target: SOD1; (-) strand; PAM type: YTN; PAM sequence: CTC
tcaggtacataaatacatta

SEQ ID NO: 13863 - DNA, 20 bp, Artificial Sequence
  Description of Artificial Sequence: Synthetic oligonucleotide
  Target: SOD1; (-) strand; PAM type: YTN; PAM sequence: TTC
tctcaggtacataaatacat

SEQ ID NO: 13864 - DNA, 20 bp, Artificial Sequence
  Description of Artificial Sequence: Synthetic oligonucleotide
  Target: SOD1; (-) strand; PAM type: YTN; PAM sequence: TTG
aaaagcattctctcaggtac

SEQ ID NO: 13865 - DNA, 20 bp, Artificial Sequence
  Description of Artificial Sequence: Synthetic oligonucleotide
  Target: SOD1; (-) strand; PAM type: YTN; PAM sequence: TTA
acattgaaaagcattctctc

SEQ ID NO: 13866 - DNA, 20 bp, Artificial Sequence
  Description of Artificial Sequence: Synthetic oligonucleotide
  Target: SOD1; (-) strand; PAM type: YTN; PAM sequence: TTA
ggttaacattgaaaagcatt

SEQ ID NO: 13867 - DNA, 20 bp, Artificial Sequence
  Description of Artificial Sequence: Synthetic oligonucleotide
  Target: SOD1; (-) strand; PAM type: YTN; PAM sequence: CTG
agttaggttaacattgaaaa

SEQ ID NO: 13868 - DNA, 20 bp, Artificial Sequence
  Description of Artificial Sequence: Synthetic oligonucleotide
  Target: SOD1; (-) strand; PAM type: YTN; PAM sequence: TTA
gtcaaacctgagttaggtta

SEQ ID NO: 13869 - DNA, 20 bp, Artificial Sequence
  Description of Artificial Sequence: Synthetic oligonucleotide
  Target: SOD1; (-) strand; PAM type: YTN; PAM sequence: TTT
agtcaaacctgagttaggtt

SEQ ID NO: 13870 - DNA, 20 bp, Artificial Sequence
  Description of Artificial Sequence: Synthetic oligonucleotide
  Target: SOD1; (-) strand; PAM type: YTN; PAM sequence: TTG
aataatttagtcaaacctga

SEQ ID NO: 13871 - DNA, 20 bp, Artificial Sequence
  Description of Artificial Sequence: Synthetic oligonucleotide
  Target: SOD1; (-) strand; PAM type: YTN; PAM sequence: TTC
caattgaataatttagtcaa

SEQ ID NO: 13872 - DNA, 20 bp, Artificial Sequence
  Description of Artificial Sequence: Synthetic oligonucleotide
  Target: SOD1; (-) strand; PAM type: YTN; PAM sequence: TTT
ccaattgaataatttagtca

SEQ ID NO: 13873 - DNA, 20 bp, Artificial Sequence
  Description of Artificial Sequence: Synthetic oligonucleotide
  Target: SOD1; (-) strand; PAM type: YTN; PAM sequence: CTA
caatttccaattgaataatt

SEQ ID NO: 13874 - DNA, 20 bp, Artificial Sequence
  Description of Artificial Sequence: Synthetic oligonucleotide
  Target: SOD1; (-) strand; PAM type: YTN; PAM sequence: TTC
tacaatttccaattgaataa

SEQ ID NO: 13875 - DNA, 20 bp, Artificial Sequence
  Description of Artificial Sequence: Synthetic oligonucleotide
  Target: SOD1; (-) strand; PAM type: YTN; PAM sequence: TTA
tcagaaataatattctacaa

SEQ ID NO: 13876 - DNA, 20 bp, Artificial Sequence
  Description of Artificial Sequence: Synthetic oligonucleotide
  Target: SOD1; (-) strand; PAM type: YTN; PAM sequence: TTT
atcagaaataatattctaca

SEQ ID NO: 13877 - DNA, 20 bp, Artificial Sequence
  Description of Artificial Sequence: Synthetic oligonucleotide
  Target: SOD1; (-) strand; PAM type: YTN; PAM sequence: CTG
gtttatcagaaataatattc

SEQ ID NO: 13878 - DNA, 20 bp, Artificial Sequence
  Description of Artificial Sequence: Synthetic oligonucleotide
  Target: SOD1; (-) strand; PAM type: YTN; PAM sequence: TTC
tggtttatcagaaataatat

SEQ ID NO: 13879 - DNA, 20 bp, Artificial Sequence
  Description of Artificial Sequence: Synthetic oligonucleotide
  Target: SOD1; (-) strand; PAM type: YTN; PAM sequence: TTT
ctggtttatcagaaataata

SEQ ID NO: 13880 - DNA, 20 bp, Artificial Sequence
  Description of Artificial Sequence: Synthetic oligonucleotide
  Target: SOD1; (-) strand; PAM type: YTN; PAM sequence: TTA
tttctggtttatcagaaata

SEQ ID NO: 13881 - DNA, 20 bp, Artificial Sequence
  Description of Artificial Sequence: Synthetic oligonucleotide
  Target: SOD1; (-) strand; PAM type: YTN; PAM sequence: CTT
atttctggtttatcagaaat

SEQ ID NO: 13882 - DNA, 20 bp, Artificial Sequence
  Description of Artificial Sequence: Synthetic oligonucleotide
  Target: SOD1; (-) strand; PAM type: YTN; PAM sequence: TTC
acttatttctggtttatcag

SEQ ID NO: 13883 - DNA, 20 bp, Artificial Sequence
  Description of Artificial Sequence: Synthetic oligonucleotide
  Target: SOD1; (-) strand; PAM type: YTN; PAM sequence: TTT
cacttatttctggtttatca

SEQ ID NO: 13884 - DNA, 20 bp, Artificial Sequence
  Description of Artificial Sequence: Synthetic oligonucleotide
  Target: SOD1; (-) strand; PAM type: YTN; PAM sequence: TTA
tgaacaaacagcatttcact

SEQ ID NO: 13885 - DNA, 20 bp, Artificial Sequence
  Description of Artificial Sequence: Synthetic oligonucleotide
  Target: SOD1; (-) strand; PAM type: YTN; PAM sequence: TTT
atgaacaaacagcatttcac

SEQ ID NO: 13886 - DNA, 20 bp, Artificial Sequence
  Description of Artificial Sequence: Synthetic oligonucleotide
  Target: SOD1; (-) strand; PAM type: YTN; PAM sequence: TTG
ataaagtacatatttatgaa

SEQ ID NO: 13887 - DNA, 20 bp, Artificial Sequence
  Description of Artificial Sequence: Synthetic oligonucleotide
  Target: SOD1; (-) strand; PAM type: YTN; PAM sequence: TTT
gataaagtacatatttatga

SEQ ID NO: 13888 - DNA, 20 bp, Artificial Sequence
  Description of Artificial Sequence: Synthetic oligonucleotide
  Target: SOD1; (-) strand; PAM type: YTN; PAM sequence: CTA
catttgataaagtacatatt

SEQ ID NO: 13889 - DNA, 20 bp, Artificial Sequence
  Description of Artificial Sequence: Synthetic oligonucleotide
  Target: SOD1; (-) strand; PAM type: YTN; PAM sequence: CTC
ctacatttgataaagtacat

SEQ ID NO: 13890 - DNA, 20 bp, Artificial Sequence
  Description of Artificial Sequence: Synthetic oligonucleotide
  Target: SOD1; (-) strand; PAM type: YTN; PAM sequence: CTC
tcctacatttgataaagtac

SEQ ID NO: 13891 - DNA, 20 bp, Artificial Sequence
  Description of Artificial Sequence: Synthetic oligonucleotide
  Target: SOD1; (-) strand; PAM type: YTN; PAM sequence: CTA
aatgatctctcctacatttg

SEQ ID NO: 13892 - DNA, 20 bp, Artificial Sequence
  Description of Artificial Sequence: Synthetic oligonucleotide
  Target: SOD1; (-) strand; PAM type: YTN; PAM sequence: CTC
ctaaatgatctctcctacat

SEQ ID NO: 13893 - DNA, 20 bp, Artificial Sequence
  Description of Artificial Sequence: Synthetic oligonucleotide
  Target: SOD1; (-) strand; PAM type: YTN; PAM sequence: CTC
tcctaaatgatctctcctac

SEQ ID NO: 13894 - DNA, 20 bp, Artificial Sequence
  Description of Artificial Sequence: Synthetic oligonucleotide
  Target: SOD1; (-) strand; PAM type: YTN; PAM sequence: TTC
ctctcctaaatgatctctcc

SEQ ID NO: 13895 - DNA, 20 bp, Artificial Sequence
  Description of Artificial Sequence: Synthetic oligonucleotide
  Target: SOD1; (-) strand; PAM type: YTN; PAM sequence: TTT
cctctcctaaatgatctctc

SEQ ID NO: 13896 - DNA, 20 bp, Artificial Sequence
  Description of Artificial Sequence: Synthetic oligonucleotide
  Target: SOD1; (-) strand; PAM type: YTN; PAM sequence: TTT
tcctctcctaaatgatctct

SEQ ID NO: 13897 - DNA, 20 bp, Artificial Sequence
  Description of Artificial Sequence: Synthetic oligonucleotide
  Target: SOD1; (-) strand; PAM type: YTN; PAM sequence: CTT
ttcctctcctaaatgatctc

SEQ ID NO: 13898 - DNA, 20 bp, Artificial Sequence
  Description of Artificial Sequence: Synthetic oligonucleotide
  Target: SOD1; (-) strand; PAM type: YTN; PAM sequence: TTA
gcttttcctctcctaaatga

SEQ ID NO: 13899 - DNA, 20 bp, Artificial Sequence
  Description of Artificial Sequence: Synthetic oligonucleotide
  Target: SOD1; (-) strand; PAM type: YTN; PAM sequence: TTT
agcttttcctctcctaaatg

SEQ ID NO: 13900 - DNA, 20 bp, Artificial Sequence
  Description of Artificial Sequence: Synthetic oligonucleotide
  Target: SOD1; (-) strand; PAM type: YTN; PAM sequence: TTC
caatttagcttttcctctcc

SEQ ID NO: 13901 - DNA, 20 bp, Artificial Sequence
  Description of Artificial Sequence: Synthetic oligonucleotide
  Target: SOD1; (-) strand; PAM type: YTN; PAM sequence: CTT
ccaatttagcttttcctctc

SEQ ID NO: 13902 - DNA, 20 bp, Artificial Sequence
  Description of Artificial Sequence: Synthetic oligonucleotide
  Target: SOD1; (-) strand; PAM type: YTN; PAM sequence: TTG
tcttccaatttagcttttcc

SEQ ID NO: 13903 - DNA, 20 bp, Artificial Sequence
  Description of Artificial Sequence: Synthetic oligonucleotide
  Target: SOD1; (-) strand; PAM type: YTN; PAM sequence: TTT
gtcttccaatttagcttttc

SEQ ID NO: 13904 - DNA, 20 bp, Artificial Sequence
  Description of Artificial Sequence: Synthetic oligonucleotide
  Target: SOD1; (-) strand; PAM type: YTN; PAM sequence: CTA
cagatttgtcttccaattta

SEQ ID NO: 13905 - DNA, 20 bp, Artificial Sequence
  Description of Artificial Sequence: Synthetic oligonucleotide
  Target: SOD1; (-) strand; PAM type: YTN; PAM sequence: TTG
gaaacactacagatttgtct

SEQ ID NO: 13906 - DNA, 20 bp, Artificial Sequence
  Description of Artificial Sequence: Synthetic oligonucleotide
  Target: SOD1; (-) strand; PAM type: YTN; PAM sequence: TTT
ggaaacactacagatttgtc

SEQ ID NO: 13907 - DNA, 20 bp, Artificial Sequence
  Description of Artificial Sequence: Synthetic oligonucleotide
  Target: SOD1; (-) strand; PAM type: YTN; PAM sequence: CTT
tggaaacactacagatttgt

SEQ ID NO: 13908 - DNA, 20 bp, Artificial Sequence
  Description of Artificial Sequence: Synthetic oligonucleotide
  Target: SOD1; (-) strand; PAM type: YTN; PAM sequence: TTA
aaactttggaaacactacag

SEQ ID NO: 13909 - DNA, 20 bp, Artificial Sequence
  Description of Artificial Sequence: Synthetic oligonucleotide
  Target: SOD1; (-) strand; PAM type: YTN; PAM sequence: TTT
aaaactttggaaacactaca

SEQ ID NO: 13910 - DNA, 20 bp, Artificial Sequence
  Description of Artificial Sequence: Synthetic oligonucleotide
  Target: SOD1; (-) strand; PAM type: YTN; PAM sequence: TTT
taaaactttggaaacactac

SEQ ID NO: 13911 - DNA, 20 bp, Artificial Sequence
  Description of Artificial Sequence: Synthetic oligonucleotide
  Target: SOD1; (-) strand; PAM type: YTN; PAM sequence: TTA
ccataattttaaaactttgg

SEQ ID NO: 13912 - DNA, 20 bp, Artificial Sequence
  Description of Artificial Sequence: Synthetic oligonucleotide
  Target: SOD1; (-) strand; PAM type: YTN; PAM sequence: TTT
accataattttaaaactttg

SEQ ID NO: 13913 - DNA, 20 bp, Artificial Sequence
  Description of Artificial Sequence: Synthetic oligonucleotide
  Target: SOD1; (-) strand; PAM type: YTN; PAM sequence: TTG
tttaccataattttaaaact

SEQ ID NO: 13914 - DNA, 20 bp, Artificial Sequence
  Description of Artificial Sequence: Synthetic oligonucleotide
  Target: SOD1; (-) strand; PAM type: YTN; PAM sequence: CTG
ttgtttaccataattttaaa

SEQ ID NO: 13915 - DNA, 20 bp, Artificial Sequence
  Description of Artificial Sequence: Synthetic oligonucleotide
  Target: SOD1; (-) strand; PAM type: YTN; PAM sequence: CTG
tgaacatactgttgtttacc

SEQ ID NO: 13916 - DNA, 20 bp, Artificial Sequence
  Description of Artificial Sequence: Synthetic oligonucleotide
  Target: SOD1; (-) strand; PAM type: YTN; PAM sequence: TTA
ctgtgaacatactgttgttt

SEQ ID NO: 13917 - DNA, 20 bp, Artificial Sequence
  Description of Artificial Sequence: Synthetic oligonucleotide
  Target: SOD1; (-) strand; PAM type: YTN; PAM sequence: CTT
actgtgaacatactgttgtt

SEQ ID NO: 13918 - DNA, 20 bp, Artificial Sequence
  Description of Artificial Sequence: Synthetic oligonucleotide
  Target: SOD1; (-) strand; PAM type: YTN; PAM sequence: TTA
accacttactgtgaacatac

SEQ ID NO: 13919 - DNA, 20 bp, Artificial Sequence
  Description of Artificial Sequence: Synthetic oligonucleotide
  Target: SOD1; (-) strand; PAM type: YTN; PAM sequence: TTT
aaccacttactgtgaacata

SEQ ID NO: 13920 - DNA, 20 bp, Artificial Sequence
  Description of Artificial Sequence: Synthetic oligonucleotide
  Target: SOD1; (-) strand; PAM type: YTN; PAM sequence: TTT
taaccacttactgtgaacat

SEQ ID NO: 13921 - DNA, 20 bp, Artificial Sequence
  Description of Artificial Sequence: Synthetic oligonucleotide
  Target: SOD1; (-) strand; PAM type: YTN; PAM sequence: TTG
ttttaaccacttactgtgaa

SEQ ID NO: 13922 - DNA, 20 bp, Artificial Sequence
  Description of Artificial Sequence: Synthetic oligonucleotide
  Target: SOD1; (-) strand; PAM type: YTN; PAM sequence: TTA
aagaatggttgttttaacca

SEQ ID NO: 13923 - DNA, 20 bp, Artificial Sequence
  Description of Artificial Sequence: Synthetic oligonucleotide
  Target: SOD1; (-) strand; PAM type: YTN; PAM sequence: TTT
aaagaatggttgttttaacc

SEQ ID NO: 13924 - DNA, 20 bp, Artificial Sequence
  Description of Artificial Sequence: Synthetic oligonucleotide
  Target: SOD1; (-) strand; PAM type: YTN; PAM sequence: CTG
agatttaaagaatggttgtt

SEQ ID NO: 13925 - DNA, 20 bp, Artificial Sequence
  Description of Artificial Sequence: Synthetic oligonucleotide
  Target: SOD1; (-) strand; PAM type: YTN; PAM sequence: CTA
ctgagatttaaagaatggtt

SEQ ID NO: 13926 - DNA, 20 bp, Artificial Sequence
  Description of Artificial Sequence: Synthetic oligonucleotide
  Target: SOD1; (-) strand; PAM type: YTN; PAM sequence: CTC
tactgagatttaaagaatgg

SEQ ID NO: 13927 - DNA, 20 bp, Artificial Sequence
  Description of Artificial Sequence: Synthetic oligonucleotide
  Target: SOD1; (-) strand; PAM type: YTN; PAM sequence: TTC
tctactgagatttaaagaat

SEQ ID NO: 13928 - DNA, 20 bp, Artificial Sequence
  Description of Artificial Sequence: Synthetic oligonucleotide
  Target: SOD1; (-) strand; PAM type: YTN; PAM sequence: TTA
aaaattctctactgagattt

SEQ ID NO: 13929 - DNA, 20 bp, Artificial Sequence
  Description of Artificial Sequence: Synthetic oligonucleotide
  Target: SOD1; (-) strand; PAM type: YTN; PAM sequence: TTT
aaaaattctctactgagatt

SEQ ID NO: 13930 - DNA, 20 bp, Artificial Sequence
  Description of Artificial Sequence: Synthetic oligonucleotide
  Target: SOD1; (-) strand; PAM type: YTN; PAM sequence: TTT
taaaaattctctactgagat

SEQ ID NO: 13931 - DNA, 20 bp, Artificial Sequence
  Description of Artificial Sequence: Synthetic oligonucleotide
  Target: SOD1; (-) strand; PAM type: YTN; PAM sequence: TTT
ttaaaaattctctactgaga

SEQ ID NO: 13932 - DNA, 20 bp, Artificial Sequence
  Description of Artificial Sequence: Synthetic oligonucleotide
  Target: SOD1; (-) strand; PAM type: YTN; PAM sequence: CTT
tttaaaaattctctactgag

SEQ ID NO: 13933 - DNA, 20 bp, Artificial Sequence
  Description of Artificial Sequence: Synthetic oligonucleotide
  Target: SOD1; (-) strand; PAM type: YTN; PAM sequence: CTG
ctttttaaaaattctctact

SEQ ID NO: 13934 - DNA, 20 bp, Artificial Sequence
  Description of Artificial Sequence: Synthetic oligonucleotide
  Target: SOD1; (-) strand; PAM type: YTN; PAM sequence: TTA
aatactgctttttaaaaatt

SEQ ID NO: 13935 - DNA, 20 bp, Artificial Sequence
  Description of Artificial Sequence: Synthetic oligonucleotide
  Target: SOD1; (-) strand; PAM type: YTN; PAM sequence: TTA
gggaaatgtgttaaatactg

SEQ ID NO: 13936 - DNA, 20 bp, Artificial Sequence
  Description of Artificial Sequence: Synthetic oligonucleotide
  Target: SOD1; (-) strand; PAM type: YTN; PAM sequence: CTA
cattagggaaatgtgttaaa

SEQ ID NO: 13937 - DNA, 20 bp, Artificial Sequence
  Description of Artificial Sequence: Synthetic oligonucleotide
  Target: SOD1; (-) strand; PAM type: YTN; PAM sequence: TTC
cacataggcaacaaactaca

SEQ ID NO: 13938 - DNA, 20 bp, Artificial Sequence
  Description of Artificial Sequence: Synthetic oligonucleotide
  Target: SOD1; (-) strand; PAM type: YTN; PAM sequence: TTA
ttccacataggcaacaaact

SEQ ID NO: 13939 - DNA, 20 bp, Artificial Sequence
  Description of Artificial Sequence: Synthetic oligonucleotide
  Target: SOD1; (-) strand; PAM type: YTN; PAM sequence: TTG
agttattccacataggcaac

SEQ ID NO: 13940 - DNA, 20 bp, Artificial Sequence
  Description of Artificial Sequence: Synthetic oligonucleotide
  Target: SOD1; (-) strand; PAM type: YTN; PAM sequence: CTA
attgagttattccacatagg

SEQ ID NO: 13941 - DNA, 20 bp, Artificial Sequence
  Description of Artificial Sequence: Synthetic oligonucleotide
  Target: SOD1; (-) strand; PAM type: YTN; PAM sequence: CTC
taattgagttattccacata

SEQ ID NO: 13942 - DNA, 20 bp, Artificial Sequence
  Description of Artificial Sequence: Synthetic oligonucleotide
  Target: SOD1; (-) strand; PAM type: YTN; PAM sequence: TTC
aaaaggcataagtgagtctc

SEQ ID NO: 13943 - DNA, 20 bp, Artificial Sequence
  Description of Artificial Sequence: Synthetic oligonucleotide
  Target: SOD1; (-) strand; PAM type: YTN; PAM sequence: TTT
caaaaggcataagtgagtct

SEQ ID NO: 13944 - DNA, 20 bp, Artificial Sequence
  Description of Artificial Sequence: Synthetic oligonucleotide
  Target: SOD1; (-) strand; PAM type: YTN; PAM sequence: TTG
aagtttcaaaaggcataagt

SEQ ID NO: 13945 - DNA, 20 bp, Artificial Sequence
  Description of Artificial Sequence: Synthetic oligonucleotide
  Target: SOD1; (-) strand; PAM type: YTN; PAM sequence: TTT
gaagtttcaaaaggcataag

SEQ ID NO: 13946 - DNA, 20 bp, Artificial Sequence
  Description of Artificial Sequence: Synthetic oligonucleotide
  Target: SOD1; (-) strand; PAM type: YTN; PAM sequence: TTA
tatttgaagtttcaaaaggc

SEQ ID NO: 13947 - DNA, 20 bp, Artificial Sequence
  Description of Artificial Sequence: Synthetic oligonucleotide
  Target: SOD1; (-) strand; PAM type: YTN; PAM sequence: CTG
gtagtgtaattatatttgaa

SEQ ID NO: 13948 - DNA, 20 bp, Artificial Sequence
  Description of Artificial Sequence: Synthetic oligonucleotide
  Target: SOD1; (-) strand; PAM type: YTN; PAM sequence: CTA
tatgcacatgtaaaaactgg

SEQ ID NO: 13949 - DNA, 20 bp, Artificial Sequence
  Description of Artificial Sequence: Synthetic oligonucleotide
  Target: SOD1; (-) strand; PAM type: YTN; PAM sequence: TTG
ggaccatcctatatgcacat

SEQ ID NO: 13950 - DNA, 20 bp, Artificial Sequence
  Description of Artificial Sequence: Synthetic oligonucleotide
  Target: SOD1; (-) strand; PAM type: YTN; PAM sequence: TTA
aagtattgggaccatcctat

SEQ ID NO: 13951 - DNA, 20 bp, Artificial Sequence
  Description of Artificial Sequence: Synthetic oligonucleotide
  Target: SOD1; (-) strand; PAM type: YTN; PAM sequence: TTT
aaagtattgggaccatccta

SEQ ID NO: 13952 - DNA, 20 bp, Artificial Sequence
  Description of Artificial Sequence: Synthetic oligonucleotide
  Target: SOD1; (-) strand; PAM type: YTN; PAM sequence: TTC
caatttaaagtattgggacc

SEQ ID NO: 13953 - DNA, 20 bp, Artificial Sequence
  Description of Artificial Sequence: Synthetic oligonucleotide
  Target: SOD1; (-) strand; PAM type: YTN; PAM sequence: TTT
ccaatttaaagtattgggac

SEQ ID NO: 13954 - DNA, 20 bp, Artificial Sequence
  Description of Artificial Sequence: Synthetic oligonucleotide
  Target: SOD1; (-) strand; PAM type: YTN; PAM sequence: CTG
tatttccaatttaaagtatt

SEQ ID NO: 13955 - DNA, 20 bp, Artificial Sequence
  Description of Artificial Sequence: Synthetic oligonucleotide
  Target: SOD1; (-) strand; PAM type: YTN; PAM sequence: TTA
cagcctgtatttccaattta

SEQ ID NO: 13956 - DNA, 20 bp, Artificial Sequence
  Description of Artificial Sequence: Synthetic oligonucleotide
  Target: SOD1; (-) strand; PAM type: YTN; PAM sequence: CTT
acagcctgtatttccaattt

SEQ ID NO: 13957 - DNA, 20 bp, Artificial Sequence
  Description of Artificial Sequence: Synthetic oligonucleotide
  Target: SOD1; (-) strand; PAM type: YTN; PAM sequence: TTG
aaggacttacagcctgtatt

SEQ ID NO: 13958 - DNA, 20 bp, Artificial Sequence
  Description of Artificial Sequence: Synthetic oligonucleotide
  Target: SOD1; (-) strand; PAM type: YTN; PAM sequence: CTT
gaaggacttacagcctgtat

SEQ ID NO: 13959 - DNA, 20 bp, Artificial Sequence
  Description of Artificial Sequence: Synthetic oligonucleotide
  Target: SOD1; (-) strand; PAM type: YTN; PAM sequence: TTA
cccaacatccagacttgaag

SEQ ID NO: 13960 - DNA, 20 bp, Artificial Sequence
  Description of Artificial Sequence: Synthetic oligonucleotide
  Target: SOD1; (-) strand; PAM type: YTN; PAM sequence: CTG
gaagaaaacgtgattaccca

SEQ ID NO: 13961 - DNA, 20 bp, Artificial Sequence
  Description of Artificial Sequence: Synthetic oligonucleotide
  Target: SOD1; (-) strand; PAM type: YTN; PAM sequence: TTC
tggaagaaaacgtgattacc

SEQ ID NO: 13962 - DNA, 20 bp, Artificial Sequence
  Description of Artificial Sequence: Synthetic oligonucleotide
  Target: SOD1; (-) strand; PAM type: YTN; PAM sequence: CTT
ctggaagaaaacgtgattac

SEQ ID NO: 13963 - DNA, 20 bp, Artificial Sequence
  Description of Artificial Sequence: Synthetic oligonucleotide
  Target: SOD1; (-) strand; PAM type: YTN; PAM sequence: CTA
acaaatggcttctggaagaa

SEQ ID NO: 13964 - DNA, 20 bp, Artificial Sequence
  Description of Artificial Sequence: Synthetic oligonucleotide
  Target: SOD1; (-) strand; PAM type: YTN; PAM sequence: TTA
aagtcctaacaaatggcttc

SEQ ID NO: 13965 - DNA, 20 bp, Artificial Sequence
  Description of Artificial Sequence: Synthetic oligonucleotide
  Target: SOD1; (-) strand; PAM type: YTN; PAM sequence: TTT
aaagtcctaacaaatggctt

SEQ ID NO: 13966 - DNA, 20 bp, Artificial Sequence
  Description of Artificial Sequence: Synthetic oligonucleotide
  Target: SOD1; (-) strand; PAM type: YTN; PAM sequence: TTT
taaagtcctaacaaatggct

SEQ ID NO: 13967 - DNA, 20 bp, Artificial Sequence
  Description of Artificial Sequence: Synthetic oligonucleotide
  Target: SOD1; (-) strand; PAM type: YTN; PAM sequence: CTG
agaagttttaaagtcctaac

SEQ ID NO: 13968 - DNA, 20 bp, Artificial Sequence
  Description of Artificial Sequence: Synthetic oligonucleotide
  Target: SOD1; (-) strand; PAM type: YTN; PAM sequence: CTG
gcccactgagaagttttaaa

SEQ ID NO: 13969 - DNA, 20 bp, Artificial Sequence
  Description of Artificial Sequence: Synthetic oligonucleotide
  Target: SOD1; (-) strand; PAM type: YTN; PAM sequence: TTA
cactggcccactgagaagtt

SEQ ID NO: 13970 - DNA, 20 bp, Artificial Sequence
  Description of Artificial Sequence: Synthetic oligonucleotide
  Target: SOD1; (-) strand; PAM type: YTN; PAM sequence: TTT
acactggcccactgagaagt

SEQ ID NO: 13971 - DNA, 20 bp, Artificial Sequence
  Description of Artificial Sequence: Synthetic oligonucleotide
  Target: SOD1; (-) strand; PAM type: YTN; PAM sequence: TTT
tacactggcccactgagaag

SEQ ID NO: 13972 - DNA, 20 bp, Artificial Sequence
  Description of Artificial Sequence: Synthetic oligonucleotide
  Target: SOD1; (-) strand; PAM type: YTN; PAM sequence: TTA
attttacactggcccactga

SEQ ID NO: 13973 - DNA, 20 bp, Artificial Sequence
  Description of Artificial Sequence: Synthetic oligonucleotide
  Target: SOD1; (-) strand; PAM type: YTN; PAM sequence: CTT
aattttacactggcccactg

SEQ ID NO: 13974 - DNA, 20 bp, Artificial Sequence
  Description of Artificial Sequence: Synthetic oligonucleotide
  Target: SOD1; (-) strand; PAM type: YTN; PAM sequence: TTG
tccttaattttacactggcc

SEQ ID NO: 13975 - DNA, 20 bp, Artificial Sequence
  Description of Artificial Sequence: Synthetic oligonucleotide
  Target: SOD1; (-) strand; PAM type: YTN; PAM sequence: CTT
gtccttaattttacactggc

SEQ ID NO: 13976 - DNA, 20 bp, Artificial Sequence
  Description of Artificial Sequence: Synthetic oligonucleotide
  Target: SOD1; (-) strand; PAM type: YTN; PAM sequence: TTA
taaaacttgtccttaatttt

SEQ ID NO: 13977 - DNA, 20 bp, Artificial Sequence
  Description of Artificial Sequence: Synthetic oligonucleotide
  Target: SOD1; (-) strand; PAM type: YTN; PAM sequence: TTA
aattataaaacttgtcctta

SEQ ID NO: 13978 - DNA, 20 bp, Artificial Sequence
  Description of Artificial Sequence: Synthetic oligonucleotide
  Target: SOD1; (-) strand; PAM type: YTN; PAM sequence: TTT
aaattataaaacttgtcctt

SEQ ID NO: 13979 - DNA, 20 bp, Artificial Sequence
  Description of Artificial Sequence: Synthetic oligonucleotide
  Target: SOD1; (-) strand; PAM type: YTN; PAM sequence: CTG
taaatttaaattataaaact

SEQ ID NO: 13980 - DNA, 20 bp, Artificial Sequence
  Description of Artificial Sequence: Synthetic oligonucleotide
  Target: SOD1; (-) strand; PAM type: YTN; PAM sequence: TTA
tctgtaaatttaaattataa

SEQ ID NO: 13981 - DNA, 20 bp, Artificial Sequence
  Description of Artificial Sequence: Synthetic oligonucleotide
  Target: SOD1; (-) strand; PAM type: YTN; PAM sequence: TTT
atctgtaaatttaaattata

SEQ ID NO: 13982 - DNA, 20 bp, Artificial Sequence
  Description of Artificial Sequence: Synthetic oligonucleotide
  Target: SOD1; (-) strand; PAM type: YTN; PAM sequence: TTA
tatttatctgtaaatttaaa

SEQ ID NO: 13983 - DNA, 20 bp, Artificial Sequence
  Description of Artificial Sequence: Synthetic oligonucleotide
  Target: SOD1; (-) strand; PAM type: YTN; PAM sequence: TTT
atatttatctgtaaatttaa

SEQ ID NO: 13984 - DNA, 20 bp, Artificial Sequence
  Description of Artificial Sequence: Synthetic oligonucleotide
  Target: SOD1; (-) strand; PAM type: YTN; PAM sequence: TTT
tatatttatctgtaaattta

SEQ ID NO: 13985 - DNA, 20 bp, Artificial Sequence
  Description of Artificial Sequence: Synthetic oligonucleotide
  Target: SOD1; (-) strand; PAM type: YTN; PAM sequence: TTG
ttttatatttatctgtaaat

SEQ ID NO: 13986 - DNA, 20 bp, Artificial Sequence
  Description of Artificial Sequence: Synthetic oligonucleotide
  Target: SOD1; (-) strand; PAM type: YTN; PAM sequence: TTA
gaaaatgagagaaaattgtt

SEQ ID NO: 13987 - DNA, 20 bp, Artificial Sequence
  Description of Artificial Sequence: Synthetic oligonucleotide
  Target: SOD1; (-) strand; PAM type: YTN; PAM sequence: TTT
agaaaatgagagaaaattgt

SEQ ID NO: 13988 - DNA, 20 bp, Artificial Sequence
  Description of Artificial Sequence: Synthetic oligonucleotide
  Target: SOD1; (-) strand; PAM type: YTN; PAM sequence: CTT
tagaaaatgagagaaaattg

SEQ ID NO: 13989 - DNA, 20 bp, Artificial Sequence
  Description of Artificial Sequence: Synthetic oligonucleotide
  Target: SOD1; (-) strand; PAM type: YTN; PAM sequence: CTG
cctttagaaaatgagagaaa

SEQ ID NO: 13990 - DNA, 20 bp, Artificial Sequence
  Description of Artificial Sequence: Synthetic oligonucleotide
  Target: SOD1; (-) strand; PAM type: YTN; PAM sequence: TTC
ctgcctttagaaaatgagag

SEQ ID NO: 13991 - DNA, 20 bp, Artificial Sequence
  Description of Artificial Sequence: Synthetic oligonucleotide
  Target: SOD1; (-) strand; PAM type: YTN; PAM sequence: TTA
tattcctgcctttagaaaat

SEQ ID NO: 13992 - DNA, 20 bp, Artificial Sequence
  Description of Artificial Sequence: Synthetic oligonucleotide
  Target: SOD1; (-) strand; PAM type: YTN; PAM sequence: CTT
atattcctgcctttagaaaa

SEQ ID NO: 13993 - DNA, 20 bp, Artificial Sequence
  Description of Artificial Sequence: Synthetic oligonucleotide
  Target: SOD1; (-) strand; PAM type: YTN; PAM sequence: CTA
gggcaatgtccttatattcc

SEQ ID NO: 13994 - DNA, 20 bp, Artificial Sequence
  Description of Artificial Sequence: Synthetic oligonucleotide
  Target: SOD1; (-) strand; PAM type: YTN; PAM sequence: TTG
atggggagaatatatctagg

SEQ ID NO: 13995 - DNA, 20 bp, Artificial Sequence
  Description of Artificial Sequence: Synthetic oligonucleotide
  Target: SOD1; (-) strand; PAM type: YTN; PAM sequence: TTT
gatggggagaatatatctag

SEQ ID NO: 13996 - DNA, 20 bp, Artificial Sequence
  Description of Artificial Sequence: Synthetic oligonucleotide
  Target: SOD1; (-) strand; PAM type: YTN; PAM sequence: TTG
gtttgatggggagaatatat

SEQ ID NO: 13997 - DNA, 20 bp, Artificial Sequence
  Description of Artificial Sequence: Synthetic oligonucleotide
  Target: SOD1; (-) strand; PAM type: YTN; PAM sequence: TTT
ggtttgatggggagaatata

SEQ ID NO: 13998 - DNA, 20 bp, Artificial Sequence
  Description of Artificial Sequence: Synthetic oligonucleotide
  Target: SOD1; (-) strand; PAM type: YTN; PAM sequence: CTT
tggtttgatggggagaatat

SEQ ID NO: 13999 - DNA, 20 bp, Artificial Sequence
  Description of Artificial Sequence: Synthetic oligonucleotide
  Target: SOD1; (-) strand; PAM type: YTN; PAM sequence: CTC
agcagcaagacctttggttt

SEQ ID NO: 14000 - DNA, 20 bp, Artificial Sequence
  Description of Artificial Sequence: Synthetic oligonucleotide
  Target: SOD1; (-) strand; PAM type: YTN; PAM sequence: TTA
aataatactcagcagcaaga

SEQ ID NO: 14001 - DNA, 20 bp, Artificial Sequence
  Description of Artificial Sequence: Synthetic oligonucleotide
  Target: SOD1; (-) strand; PAM type: YTN; PAM sequence: TTT
aaataatactcagcagcaag

SEQ ID NO: 14002 - DNA, 20 bp, Artificial Sequence
  Description of Artificial Sequence: Synthetic oligonucleotide
  Target: SOD1; (-) strand; PAM type: YTN; PAM sequence: TTT
taaataatactcagcagcaa

SEQ ID NO: 14003 - DNA, 20 bp, Artificial Sequence
  Description of Artificial Sequence: Synthetic oligonucleotide
  Target: SOD1; (-) strand; PAM type: YTN; PAM sequence: TTT
ttaaataatactcagcagca

SEQ ID NO: 14004 - DNA, 20 bp, Artificial Sequence
  Description of Artificial Sequence: Synthetic oligonucleotide
  Target: SOD1; (-) strand; PAM type: YTN; PAM sequence: CTG
gtttttaaataatactcagc

SEQ ID NO: 14005 - DNA, 20 bp, Artificial Sequence
  Description of Artificial Sequence: Synthetic oligonucleotide
  Target: SOD1; (-) strand; PAM type: YTN; PAM sequence: CTC
tggtttttaaataatactca

SEQ ID NO: 14006 - DNA, 20 bp, Artificial Sequence
  Description of Artificial Sequence: Synthetic oligonucleotide
  Target: SOD1; (-) strand; PAM type: YTN; PAM sequence: TTA
ctctggtttttaaataatac

SEQ ID NO: 14007 - DNA, 20 bp, Artificial Sequence
  Description of Artificial Sequence: Synthetic oligonucleotide
  Target: SOD1; (-) strand; PAM type: YTN; PAM sequence: TTA
ttactctggtttttaaataa

SEQ ID NO: 14008 - DNA, 20 bp, Artificial Sequence
  Description of Artificial Sequence: Synthetic oligonucleotide
  Target: SOD1; (-) strand; PAM type: YTN; PAM sequence: TTT
attactctggtttttaaata

SEQ ID NO: 14009 - DNA, 20 bp, Artificial Sequence
  Description of Artificial Sequence: Synthetic oligonucleotide
  Target: SOD1; (-) strand; PAM type: YTN; PAM sequence: CTT
tattactctggtttttaaat

SEQ ID NO: 14010 - DNA, 20 bp, Artificial Sequence
  Description of Artificial Sequence: Synthetic oligonucleotide
  Target: SOD1; (-) strand; PAM type: YTN; PAM sequence: CTG
ctttattactctggttttta

SEQ ID NO: 14011 - DNA, 20 bp, Artificial Sequence
  Description of Artificial Sequence: Synthetic oligonucleotide
  Target: SOD1; (-) strand; PAM type: YTN; PAM sequence: CTC
aggcgaagctgctttattac

SEQ ID NO: 14012 - DNA, 20 bp, Artificial Sequence
  Description of Artificial Sequence: Synthetic oligonucleotide
  Target: SOD1; (-) strand; PAM type: YTN; PAM sequence: TTC
atcctcaggcgaagctgctt

SEQ ID NO: 14013 - DNA, 20 bp, Artificial Sequence
  Description of Artificial Sequence: Synthetic oligonucleotide
  Target: SOD1; (-) strand; PAM type: YTN; PAM sequence: CTT
catcctcaggcgaagctgct

SEQ ID NO: 14014 - DNA, 20 bp, Artificial Sequence
  Description of Artificial Sequence: Synthetic oligonucleotide
  Target: SOD1; (-) strand; PAM type: YTN; PAM sequence: TTG
ccttcatcctcaggcgaagc

SEQ ID NO: 14015 - DNA, 20 bp, Artificial Sequence
  Description of Artificial Sequence: Synthetic oligonucleotide
  Target: SOD1; (-) strand; PAM type: YTN; PAM sequence: TTT
gccttcatcctcaggcgaag

SEQ ID NO: 14016 - DNA, 20 bp, Artificial Sequence
  Description of Artificial Sequence: Synthetic oligonucleotide
  Target: SOD1; (-) strand; PAM type: YTN; PAM sequence: CTT
tgccttcatcctcaggcgaa

SEQ ID NO: 14017 - DNA, 20 bp, Artificial Sequence
  Description of Artificial Sequence: Synthetic oligonucleotide
  Target: SOD1; (-) strand; PAM type: YTN; PAM sequence: TTG
tctttgccttcatcctcagg

SEQ ID NO: 14018 - DNA, 20 bp, Artificial Sequence
  Description of Artificial Sequence: Synthetic oligonucleotide
  Target: SOD1; (-) strand; PAM type: YTN; PAM sequence: TTT
gtctttgccttcatcctcag

SEQ ID NO: 14019 - DNA, 20 bp, Artificial Sequence
  Description of Artificial Sequence: Synthetic oligonucleotide
  Target: SOD1; (-) strand; PAM type: YTN; PAM sequence: CTT
tgtctttgccttcatcctca

SEQ ID NO: 14020 - DNA, 20 bp, Artificial Sequence
  Description of Artificial Sequence: Synthetic oligonucleotide
  Target: SOD1; (-) strand; PAM type: YTN; PAM sequence: TTA
actttgtctttgccttcatc

SEQ ID NO: 14021 - DNA, 20 bp, Artificial Sequence
  Description of Artificial Sequence: Synthetic oligonucleotide
  Target: SOD1; (-) strand; PAM type: YTN; PAM sequence: CTG
agcagttaactttgtctttg

SEQ ID NO: 14022 - DNA, 20 bp, Artificial Sequence
  Description of Artificial Sequence: Synthetic oligonucleotide
  Target: SOD1; (-) strand; PAM type: YTN; PAM sequence: TTC
agtatgctgagcagttaact

SEQ ID NO: 14023 - DNA, 20 bp, Artificial Sequence
  Description of Artificial Sequence: Synthetic oligonucleotide
  Target: SOD1; (-) strand; PAM type: YTN; PAM sequence: TTT
cagtatgctgagcagttaac

SEQ ID NO: 14024 - DNA, 20 bp, Artificial Sequence
  Description of Artificial Sequence: Synthetic oligonucleotide
  Target: SOD1; (-) strand; PAM type: YTN; PAM sequence: CTG
gtttcagtatgctgagcagt

SEQ ID NO: 14025 - DNA, 20 bp, Artificial Sequence
  Description of Artificial Sequence: Synthetic oligonucleotide
  Target: SOD1; (-) strand; PAM type: YTN; PAM sequence: CTC
ctggtttcagtatgctgagc

SEQ ID NO: 14026 - DNA, 20 bp, Artificial Sequence
  Description of Artificial Sequence: Synthetic oligonucleotide
  Target: SOD1; (-) strand; PAM type: YTN; PAM sequence: TTC
aaactcctggtttcagtatg

SEQ ID NO: 14027 - DNA, 20 bp, Artificial Sequence
  Description of Artificial Sequence: Synthetic oligonucleotide
  Target: SOD1; (-) strand; PAM type: YTN; PAM sequence: TTT
caaactcctggtttcagtat

SEQ ID NO: 14028 - DNA, 20 bp, Artificial Sequence
  Description of Artificial Sequence: Synthetic oligonucleotide
  Target: SOD1; (-) strand; PAM type: YTN; PAM sequence: TTT
tcaaactcctggtttcagta

SEQ ID NO: 14029 - DNA, 20 bp, Artificial Sequence
  Description of Artificial Sequence: Synthetic oligonucleotide
  Target: SOD1; (-) strand; PAM type: YTN; PAM sequence: TTT
ttcaaactcctggtttcagt

SEQ ID NO: 14030 - DNA, 20 bp, Artificial Sequence
  Description of Artificial Sequence: Synthetic oligonucleotide
  Target: SOD1; (-) strand; PAM type: YTN; PAM sequence: CTT
tttcaaactcctggtttcag

SEQ ID NO: 14031 - DNA, 20 bp, Artificial Sequence
  Description of Artificial Sequence: Synthetic oligonucleotide
  Target: SOD1; (-) strand; PAM type: YTN; PAM sequence: TTA
ctttttcaaactcctggttt

SEQ ID NO: 14032 - DNA, 20 bp, Artificial Sequence
  Description of Artificial Sequence: Synthetic oligonucleotide
  Target: SOD1; (-) strand; PAM type: YTN; PAM sequence: TTG
aattactttttcaaactcct

SEQ ID NO: 14033 - DNA, 20 bp, Artificial Sequence
  Description of Artificial Sequence: Synthetic oligonucleotide
  Target: SOD1; (-) strand; PAM type: YTN; PAM sequence: TTT
gaattactttttcaaactcc

SEQ ID NO: 14034 - DNA, 20 bp, Artificial Sequence
  Description of Artificial Sequence: Synthetic oligonucleotide
  Target: SOD1; (-) strand; PAM type: YTN; PAM sequence: TTT
tgaattactttttcaaactc

SEQ ID NO: 14035 - DNA, 20 bp, Artificial Sequence
  Description of Artificial Sequence: Synthetic oligonucleotide
  Target: SOD1; (-) strand; PAM type: YTN; PAM sequence: TTG
ttttgaattactttttcaaa

SEQ ID NO: 14036 - DNA, 20 bp, Artificial Sequence
  Description of Artificial Sequence: Synthetic oligonucleotide
  Target: SOD1; (-) strand; PAM type: YTN; PAM sequence: TTG
aagttgttttgaattacttt

SEQ ID NO: 14037 - DNA, 20 bp, Artificial Sequence
  Description of Artificial Sequence: Synthetic oligonucleotide
  Target: SOD1; (-) strand; PAM type: YTN; PAM sequence: CTT
gaagttgttttgaattactt

SEQ ID NO: 14038 - DNA, 20 bp, Artificial Sequence
  Description of Artificial Sequence: Synthetic oligonucleotide
  Target: SOD1; (-) strand; PAM type: YTN; PAM sequence: TTA
tggccttgaagttgttttga

SEQ ID NO: 14039 - DNA, 20 bp, Artificial Sequence
  Description of Artificial Sequence: Synthetic oligonucleotide
  Target: SOD1; (-) strand; PAM type: YTN; PAM sequence: TTT
atggccttgaagttgttttg

SEQ ID NO: 14040 - DNA, 20 bp, Artificial Sequence
  Description of Artificial Sequence: Synthetic oligonucleotide
  Target: SOD1; (-) strand; PAM type: YTN; PAM sequence: CTA
tccaagtatttatggccttg

SEQ ID NO: 14041 - DNA, 20 bp, Artificial Sequence
  Description of Artificial Sequence: Synthetic oligonucleotide
  Target: SOD1; (-) strand; PAM type: YTN; PAM sequence: CTG
atgtcacactatccaagtat

SEQ ID NO: 14042 - DNA, 20 bp, Artificial Sequence
  Description of Artificial Sequence: Synthetic oligonucleotide
  Target: SOD1; (-) strand; PAM type: YTN; PAM sequence: TTG
caggaaatccagtgccaaga

SEQ ID NO: 14043 - DNA, 20 bp, Artificial Sequence
  Description of Artificial Sequence: Synthetic oligonucleotide
  Target: SOD1; (-) strand; PAM type: YTN; PAM sequence: CTG
aaattgcaggaaatccagtg

SEQ ID NO: 14044 - DNA, 20 bp, Artificial Sequence
  Description of Artificial Sequence: Synthetic oligonucleotide
  Target: SOD1; (-) strand; PAM type: YTN; PAM sequence: TTC
atctgaaattgcaggaaatc

SEQ ID NO: 14045 - DNA, 20 bp, Artificial Sequence
  Description of Artificial Sequence: Synthetic oligonucleotide
  Target: SOD1; (-) strand; PAM type: YTN; PAM sequence: CTT
catctgaaattgcaggaaat

SEQ ID NO: 14046 - DNA, 20 bp, Artificial Sequence
  Description of Artificial Sequence: Synthetic oligonucleotide
  Target: SOD1; (-) strand; PAM type: YTN; PAM sequence: CTA
aagccaagtcaagccttcat

SEQ ID NO: 14047 - DNA, 20 bp, Artificial Sequence
  Description of Artificial Sequence: Synthetic oligonucleotide
  Target: SOD1; (-) strand; PAM type: YTN; PAM sequence: TTA
tcacatgaaaacatctaaag

SEQ ID NO: 14048 - DNA, 20 bp, Artificial Sequence
  Description of Artificial Sequence: Synthetic oligonucleotide
  Target: SOD1; (-) strand; PAM type: YTN; PAM sequence: TTA
tccaagaattatcacatgaa

SEQ ID NO: 14049 - DNA, 20 bp, Artificial Sequence
  Description of Artificial Sequence: Synthetic oligonucleotide
  Target: SOD1; (-) strand; PAM type: YTN; PAM sequence: TTG
taggttatccaagaattatc

SEQ ID NO: 14050 - DNA, 20 bp, Artificial Sequence
  Description of Artificial Sequence: Synthetic oligonucleotide
  Target: SOD1; (-) strand; PAM type: YTN; PAM sequence: TTA
aataggaaaaatcgttgtag

SEQ ID NO: 14051 - DNA, 20 bp, Artificial Sequence
  Description of Artificial Sequence: Synthetic oligonucleotide
  Target: SOD1; (-) strand; PAM type: YTN; PAM sequence: TTG
gtgggttaaataggaaaaat

SEQ ID NO: 14052 - DNA, 20 bp, Artificial Sequence
  Description of Artificial Sequence: Synthetic oligonucleotide
  Target: SOD1; (-) strand; PAM type: YTN; PAM sequence: TTA
aagttggtgggttaaatagg

SEQ ID NO: 14053 - DNA, 20 bp, Artificial Sequence
  Description of Artificial Sequence: Synthetic oligonucleotide
  Target: SOD1; (-) strand; PAM type: YTN; PAM sequence: CTT
aaagttggtgggttaaatag

SEQ ID NO: 14054 - DNA, 20 bp, Artificial Sequence
  Description of Artificial Sequence: Synthetic oligonucleotide
  Target: SOD1; (-) strand; PAM type: YTN; PAM sequence: TTG
cttaaagttggtgggttaaa

SEQ ID NO: 14055 - DNA, 20 bp, Artificial Sequence
  Description of Artificial Sequence: Synthetic oligonucleotide
  Target: SOD1; (-) strand; PAM type: YTN; PAM sequence: TTT
gcttaaagttggtgggttaa

SEQ ID NO: 14056 - DNA, 20 bp, Artificial Sequence
  Description of Artificial Sequence: Synthetic oligonucleotide
  Target: SOD1; (-) strand; PAM type: YTN; PAM sequence: TTT
tgcttaaagttggtgggtta

SEQ ID NO: 14057 - DNA, 20 bp, Artificial Sequence
  Description of Artificial Sequence: Synthetic oligonucleotide
  Target: SOD1; (-) strand; PAM type: YTN; PAM sequence: CTT
ttgcttaaagttggtgggtt

SEQ ID NO: 14058 - DNA, 20 bp, Artificial Sequence
  Description of Artificial Sequence: Synthetic oligonucleotide
  Target: SOD1; (-) strand; PAM type: YTN; PAM sequence: TTC
ttttgcttaaagttggtggg

SEQ ID NO: 14059 - DNA, 20 bp, Artificial Sequence
  Description of Artificial Sequence: Synthetic oligonucleotide
  Target: SOD1; (-) strand; PAM type: YTN; PAM sequence: TTT
cttttgcttaaagttggtgg

SEQ ID NO: 14060 - DNA, 20 bp, Artificial Sequence
  Description of Artificial Sequence: Synthetic oligonucleotide
  Target: SOD1; (-) strand; PAM type: YTN; PAM sequence: CTT
tcttttgcttaaagttggtg

SEQ ID NO: 14061 - DNA, 20 bp, Artificial Sequence
  Description of Artificial Sequence: Synthetic oligonucleotide
  Target: SOD1; (-) strand; PAM type: YTN; PAM sequence: TTC
tttcttttgcttaaagttgg

SEQ ID NO: 14062 - DNA, 20 bp, Artificial Sequence
  Description of Artificial Sequence: Synthetic oligonucleotide
  Target: SOD1; (-) strand; PAM type: YTN; PAM sequence: TTC
ccccacatatacgttctttc

SEQ ID NO: 14063 - DNA, 20 bp, Artificial Sequence
  Description of Artificial Sequence: Synthetic oligonucleotide
  Target: SOD1; (-) strand; PAM type: YTN; PAM sequence: TTT
cccccacatatacgttcttt

SEQ ID NO: 14064 - DNA, 20 bp, Artificial Sequence
  Description of Artificial Sequence: Synthetic oligonucleotide
  Target: SOD1; (-) strand; PAM type: YTN; PAM sequence: TTT
tcccccacatatacgttctt

SEQ ID NO: 14065 - DNA, 20 bp, Artificial Sequence
  Description of Artificial Sequence: Synthetic oligonucleotide
  Target: SOD1; (-) strand; PAM type: YTN; PAM sequence: CTT
ttcccccacatatacgttct

SEQ ID NO: 14066 - DNA, 20 bp, Artificial Sequence
  Description of Artificial Sequence: Synthetic oligonucleotide
  Target: SOD1; (-) strand; PAM type: YTN; PAM sequence: CTG
cggggcagaggtaaacgaac

SEQ ID NO: 14067 - DNA, 20 bp, Artificial Sequence
  Description of Artificial Sequence: Synthetic oligonucleotide
  Target: SOD1; (-) strand; PAM type: YTN; PAM sequence: TTC
ccctgcggggcagaggtaaa

SEQ ID NO: 14068 - DNA, 20 bp, Artificial Sequence
  Description of Artificial Sequence: Synthetic oligonucleotide
  Target: SOD1; (-) strand; PAM type: YTN; PAM sequence: TTA
attcccctgcggggcagagg

SEQ ID NO: 14069 - DNA, 20 bp, Artificial Sequence
  Description of Artificial Sequence: Synthetic oligonucleotide
  Target: SOD1; (-) strand; PAM type: YTN; PAM sequence: TTT
aattcccctgcggggcagag

SEQ ID NO: 14070 - DNA, 20 bp, Artificial Sequence
  Description of Artificial Sequence: Synthetic oligonucleotide
  Target: SOD1; (-) strand; PAM type: YTN; PAM sequence: TTT
taattcccctgcggggcaga

SEQ ID NO: 14071 - DNA, 20 bp, Artificial Sequence
  Description of Artificial Sequence: Synthetic oligonucleotide
  Target: SOD1; (-) strand; PAM type: YTN; PAM sequence: TTC
accagcgttttaattcccct

SEQ ID NO: 14072 - DNA, 20 bp, Artificial Sequence
  Description of Artificial Sequence: Synthetic oligonucleotide
  Target: SOD1; (-) strand; PAM type: YTN; PAM sequence: CTT
caccagcgttttaattcccc

SEQ ID NO: 14073 - DNA, 20 bp, Artificial Sequence
  Description of Artificial Sequence: Synthetic oligonucleotide
  Target: SOD1; (-) strand; PAM type: YTN; PAM sequence: TTC
ttcaccagcgttttaattcc

SEQ ID NO: 14074 - DNA, 20 bp, Artificial Sequence
  Description of Artificial Sequence: Synthetic oligonucleotide
  Target: SOD1; (-) strand; PAM type: YTN; PAM sequence: TTT
cttcaccagcgttttaattc

SEQ ID NO: 14075 - DNA, 20 bp, Artificial Sequence
  Description of Artificial Sequence: Synthetic oligonucleotide
  Target: SOD1; (-) strand; PAM type: YTN; PAM sequence: CTT
tcttcaccagcgttttaatt

SEQ ID NO: 14076 - DNA, 20 bp, Artificial Sequence
  Description of Artificial Sequence: Synthetic oligonucleotide
  Target: SOD1; (-) strand; PAM type: YTN; PAM sequence: TTG
cctttcttcaccagcgtttt

SEQ ID NO: 14077 - DNA, 20 bp, Artificial Sequence
  Description of Artificial Sequence: Synthetic oligonucleotide
  Target: SOD1; (-) strand; PAM type: YTN; PAM sequence: CTG
ttgcctttcttcaccagcgt

SEQ ID NO: 14078 - DNA, 20 bp, Artificial Sequence
  Description of Artificial Sequence: Synthetic oligonucleotide
  Target: SOD1; (-) strand; PAM type: YTN; PAM sequence: TTG
cctgttgcctttcttcacca

SEQ ID NO: 14079 - DNA, 20 bp, Artificial Sequence
  Description of Artificial Sequence: Synthetic oligonucleotide
  Target: SOD1; (-) strand; PAM type: YTN; PAM sequence: CTT
gcctgttgcctttcttcacc

SEQ ID NO: 14080 - DNA, 20 bp, Artificial Sequence
  Description of Artificial Sequence: Synthetic oligonucleotide
  Target: SOD1; (-) strand; PAM type: YTN; PAM sequence: TTA
tataagccttgcctgttgcc

SEQ ID NO: 14081 - DNA, 20 bp, Artificial Sequence
  Description of Artificial Sequence: Synthetic oligonucleotide
  Target: SOD1; (-) strand; PAM type: YTN; PAM sequence: CTT
atataagccttgcctgttgc

SEQ ID NO: 14082 - DNA, 20 bp, Artificial Sequence
  Description of Artificial Sequence: Synthetic oligonucleotide
  Target: SOD1; (-) strand; PAM type: YTN; PAM sequence: TTC
cttatataagccttgcctgt

SEQ ID NO: 14083 - DNA, 20 bp, Artificial Sequence
  Description of Artificial Sequence: Synthetic oligonucleotide
  Target: SOD1; (-) strand; PAM type: YTN; PAM sequence: TTT
ccttatataagccttgcctg

SEQ ID NO: 14084 - DNA, 20 bp, Artificial Sequence
  Description of Artificial Sequence: Synthetic oligonucleotide
  Target: SOD1; (-) strand; PAM type: YTN; PAM sequence: CTG
tttccttatataagccttgc

SEQ ID NO: 14085 - DNA, 20 bp, Artificial Sequence
  Description of Artificial Sequence: Synthetic oligonucleotide
  Target: SOD1; (-) strand; PAM type: YTN; PAM sequence: CTA
ctgtttccttatataagcct

SEQ ID NO: 14086 - DNA, 20 bp, Artificial Sequence
  Description of Artificial Sequence: Synthetic oligonucleotide
  Target: SOD1; (-) strand; PAM type: YTN; PAM sequence: CTA
ctactgtttccttatataag

SEQ ID NO: 14087 - DNA, 20 bp, Artificial Sequence
  Description of Artificial Sequence: Synthetic oligonucleotide
  Target: SOD1; (-) strand; PAM type: YTN; PAM sequence: TTC
agtgcagcctactactgttt

SEQ ID NO: 14088 - DNA, 20 bp, Artificial Sequence
  Description of Artificial Sequence: Synthetic oligonucleotide
  Target: SOD1; (-) strand; PAM type: YTN; PAM sequence: CTT
cagtgcagcctactactgtt

SEQ ID NO: 14089 - DNA, 20 bp, Artificial Sequence
  Description of Artificial Sequence: Synthetic oligonucleotide
  Target: SOD1; (-) strand; PAM type: YTN; PAM sequence: TTG
aggacttcagtgcagcctac

SEQ ID NO: 14090 - DNA, 20 bp, Artificial Sequence
  Description of Artificial Sequence: Synthetic oligonucleotide
  Target: SOD1; (-) strand; PAM type: YTN; PAM sequence: TTT
gaggacttcagtgcagccta

SEQ ID NO: 14091 - DNA, 20 bp, Artificial Sequence
  Description of Artificial Sequence: Synthetic oligonucleotide
  Target: SOD1; (-) strand; PAM type: YTN; PAM sequence: TTG
tgtttgaggacttcagtgca

SEQ ID NO: 14092 - DNA, 20 bp, Artificial Sequence
  Description of Artificial Sequence: Synthetic oligonucleotide
  Target: SOD1; (-) strand; PAM type: YTN; PAM sequence: TTG
ttgtgtttgaggacttcagt

SEQ ID NO: 14093 - DNA, 20 bp, Artificial Sequence
  Description of Artificial Sequence: Synthetic oligonucleotide
  Target: SOD1; (-) strand; PAM type: YTN; PAM sequence: TTT
gttgtgtttgaggacttcag

SEQ ID NO: 14094 - DNA, 20 bp, Artificial Sequence
  Description of Artificial Sequence: Synthetic oligonucleotide
  Target: SOD1; (-) strand; PAM type: YTN; PAM sequence: TTT
tgttgtgtttgaggacttca

SEQ ID NO: 14095 - DNA, 20 bp, Artificial Sequence
  Description of Artificial Sequence: Synthetic oligonucleotide
  Target: SOD1; (-) strand; PAM type: YTN; PAM sequence: TTT
ttgttgtgtttgaggacttc

SEQ ID NO: 14096 - DNA, 20 bp, Artificial Sequence
  Description of Artificial Sequence: Synthetic oligonucleotide
  Target: SOD1; (-) strand; PAM type: YTN; PAM sequence: CTT
tttgttgtgtttgaggactt

SEQ ID NO: 14097 - DNA, 20 bp, Artificial Sequence
  Description of Artificial Sequence: Synthetic oligonucleotide
  Target: SOD1; (-) strand; PAM type: YTN; PAM sequence: CTA
agagctttttgttgtgtttg

SEQ ID NO: 14098 - DNA, 20 bp, Artificial Sequence
  Description of Artificial Sequence: Synthetic oligonucleotide
  Target: SOD1; (-) strand; PAM type: YTN; PAM sequence: TTG
caacctaagagctttttgtt

SEQ ID NO: 14099 - DNA, 20 bp, Artificial Sequence
  Description of Artificial Sequence: Synthetic oligonucleotide
  Target: SOD1; (-) strand; PAM type: YTN; PAM sequence: TTT
gcaacctaagagctttttgt

SEQ ID NO: 14100 - DNA, 20 bp, Artificial Sequence
  Description of Artificial Sequence: Synthetic oligonucleotide
  Target: SOD1; (-) strand; PAM type: YTN; PAM sequence: TTA
acatttgcaacctaagagct

SEQ ID NO: 14101 - DNA, 20 bp, Artificial Sequence
  Description of Artificial Sequence: Synthetic oligonucleotide
  Target: SOD1; (-) strand; PAM type: YTN; PAM sequence: TTC
aaaagggtaaaagaatcaag

SEQ ID NO: 14102 - DNA, 20 bp, Artificial Sequence
  Description of Artificial Sequence: Synthetic oligonucleotide
  Target: SOD1; (-) strand; PAM type: YTN; PAM sequence: TTT
caaaagggtaaaagaatcaa

SEQ ID NO: 14103 - DNA, 20 bp, Artificial Sequence
  Description of Artificial Sequence: Synthetic oligonucleotide
  Target: SOD1; (-) strand; PAM type: YTN; PAM sequence: TTT
tcaaaagggtaaaagaatca

SEQ ID NO: 14104 - DNA, 20 bp, Artificial Sequence
  Description of Artificial Sequence: Synthetic oligonucleotide
  Target: SOD1; (-) strand; PAM type: YTN; PAM sequence: TTT
ttcaaaagggtaaaagaatc

SEQ ID NO: 14105 - DNA, 20 bp, Artificial Sequence
  Description of Artificial Sequence: Synthetic oligonucleotide
  Target: SOD1; (-) strand; PAM type: YTN; PAM sequence: TTG
aatttttcaaaagggtaaaa

SEQ ID NO: 14106 - DNA, 20 bp, Artificial Sequence
  Description of Artificial Sequence: Synthetic oligonucleotide
  Target: SOD1; (-) strand; PAM type: YTN; PAM sequence: TTC
caaccatcccattgaatttt

SEQ ID NO: 14107 - DNA, 20 bp, Artificial Sequence
  Description of Artificial Sequence: Synthetic oligonucleotide
  Target: SOD1; (-) strand; PAM type: YTN; PAM sequence: TTT
ccaaccatcccattgaattt

SEQ ID NO: 14108 - DNA, 20 bp, Artificial Sequence
  Description of Artificial Sequence: Synthetic oligonucleotide
  Target: SOD1; (-) strand; PAM type: YTN; PAM sequence: TTT
tccaaccatcccattgaatt

SEQ ID NO: 14109 - DNA, 20 bp, Artificial Sequence
  Description of Artificial Sequence: Synthetic oligonucleotide
  Target: SOD1; (-) strand; PAM type: YTN; PAM sequence: TTT
ttccaaccatcccattgaat

SEQ ID NO: 14110 - DNA, 20 bp, Artificial Sequence
  Description of Artificial Sequence: Synthetic oligonucleotide
  Target: SOD1; (-) strand; PAM type: YTN; PAM sequence: TTT
tttccaaccatcccattgaa

SEQ ID NO: 14111 - DNA, 20 bp, Artificial Sequence
  Description of Artificial Sequence: Synthetic oligonucleotide
  Target: SOD1; (-) strand; PAM type: YTN; PAM sequence: TTT
ttttccaaccatcccattga

SEQ ID NO: 14112 - DNA, 20 bp, Artificial Sequence
  Description of Artificial Sequence: Synthetic oligonucleotide
  Target: SOD1; (-) strand; PAM type: YTN; PAM sequence: TTT
tttttccaaccatcccattg

SEQ ID NO: 14113 - DNA, 20 bp, Artificial Sequence
  Description of Artificial Sequence: Synthetic oligonucleotide
  Target: SOD1; (-) strand; PAM type: YTN; PAM sequence: TTT
ttttttccaaccatcccatt

SEQ ID NO: 14114 - DNA, 20 bp, Artificial Sequence
  Description of Artificial Sequence: Synthetic oligonucleotide
  Target: SOD1; (-) strand; PAM type: YTN; PAM sequence: TTT
tttttttccaaccatcccat

SEQ ID NO: 14115 - DNA, 20 bp, Artificial Sequence
  Description of Artificial Sequence: Synthetic oligonucleotide
  Target: SOD1; (-) strand; PAM type: YTN; PAM sequence: TTT
ttttttttccaaccatccca

SEQ ID NO: 14116 - DNA, 20 bp, Artificial Sequence
  Description of Artificial Sequence: Synthetic oligonucleotide
  Target: SOD1; (-) strand; PAM type: YTN; PAM sequence: TTT
tttttttttccaaccatccc

SEQ ID NO: 14117 - DNA, 20 bp, Artificial Sequence
  Description of Artificial Sequence: Synthetic oligonucleotide
  Target: SOD1; (-) strand; PAM type: YTN; PAM sequence: CTG
tggttttttttttttccaac

SEQ ID NO: 14118 - DNA, 20 bp, Artificial Sequence
  Description of Artificial Sequence: Synthetic oligonucleotide
  Target: SOD1; (-) strand; PAM type: YTN; PAM sequence: TTG
cgtgtgtgtgtgtgtgtgtc

SEQ ID NO: 14119 - DNA, 20 bp, Artificial Sequence
  Description of Artificial Sequence: Synthetic oligonucleotide
  Target: SOD1; (-) strand; PAM type: YTN; PAM sequence: TTA
gaaggttgcgtgtgtgtgtg

SEQ ID NO: 14120 - DNA, 20 bp, Artificial Sequence
  Description of Artificial Sequence: Synthetic oligonucleotide
  Target: SOD1; (-) strand; PAM type: YTN; PAM sequence: TTA
cgttagaaggttgcgtgtgt

SEQ ID NO: 14121 - DNA, 20 bp, Artificial Sequence
  Description of Artificial Sequence: Synthetic oligonucleotide
  Target: SOD1; (-) strand; PAM type: YTN; PAM sequence: CTG
ggtattacgttagaaggttg

SEQ ID NO: 14122 - DNA, 20 bp, Artificial Sequence
  Description of Artificial Sequence: Synthetic oligonucleotide
  Target: SOD1; (-) strand; PAM type: YTN; PAM sequence: CTG
cctgggtattacgttagaag

SEQ ID NO: 14123 - DNA, 20 bp, Artificial Sequence
  Description of Artificial Sequence: Synthetic oligonucleotide
  Target: SOD1; (-) strand; PAM type: YTN; PAM sequence: TTA
tcggactgcctgggtattac

SEQ ID NO: 14124 - DNA, 20 bp, Artificial Sequence
  Description of Artificial Sequence: Synthetic oligonucleotide
  Target: SOD1; (-) strand; PAM type: YTN; PAM sequence: CTA
taaattatcggactgcctgg

SEQ ID NO: 14125 - DNA, 20 bp, Artificial Sequence
  Description of Artificial Sequence: Synthetic oligonucleotide
  Target: SOD1; (-) strand; PAM type: YTN; PAM sequence: TTG
tactataaattatcggactg

SEQ ID NO: 14126 - DNA, 20 bp, Artificial Sequence
  Description of Artificial Sequence: Synthetic oligonucleotide
  Target: SOD1; (-) strand; PAM type: YTN; PAM sequence: TTA
cacgttgtactataaattat

SEQ ID NO: 14127 - DNA, 20 bp, Artificial Sequence
  Description of Artificial Sequence: Synthetic oligonucleotide
  Target: SOD1; (-) strand; PAM type: YTN; PAM sequence: TTG
gatcccagtgttacacgttg

SEQ ID NO: 14128 - DNA, 20 bp, Artificial Sequence
  Description of Artificial Sequence: Synthetic oligonucleotide
  Target: SOD1; (-) strand; PAM type: YTN; PAM sequence: CTG
ggtgaaaagttggatcccag

SEQ ID NO: 14129 - DNA, 20 bp, Artificial Sequence
  Description of Artificial Sequence: Synthetic oligonucleotide
  Target: SOD1; (-) strand; PAM type: YTN; PAM sequence: TTG
ctgggtgaaaagttggatcc

SEQ ID NO: 14130 - DNA, 20 bp, Artificial Sequence
  Description of Artificial Sequence: Synthetic oligonucleotide
  Target: SOD1; (-) strand; PAM type: YTN; PAM sequence: TTT
gctgggtgaaaagttggatc

SEQ ID NO: 14131 - DNA, 20 bp, Artificial Sequence
  Description of Artificial Sequence: Synthetic oligonucleotide
  Target: SOD1; (-) strand; PAM type: YTN; PAM sequence: TTT
tgctgggtgaaaagttggat

SEQ ID NO: 14132 - DNA, 20 bp, Artificial Sequence
  Description of Artificial Sequence: Synthetic oligonucleotide
  Target: SOD1; (-) strand; PAM type: YTN; PAM sequence: TTG
taaggagattttgctgggtg

SEQ ID NO: 14133 - DNA, 20 bp, Artificial Sequence
  Description of Artificial Sequence: Synthetic oligonucleotide
  Target: SOD1; (-) strand; PAM type: YTN; PAM sequence: TTT
gtaaggagattttgctgggt

SEQ ID NO: 14134 - DNA, 20 bp, Artificial Sequence
  Description of Artificial Sequence: Synthetic oligonucleotide
  Target: SOD1; (-) strand; PAM type: YTN; PAM sequence: CTA
atttgtaaggagattttgct

SEQ ID NO: 14135 - DNA, 20 bp, Artificial Sequence
  Description of Artificial Sequence: Synthetic oligonucleotide
  Target: SOD1; (-) strand; PAM type: YTN; PAM sequence: TTG
ccctaatttgtaaggagatt

SEQ ID NO: 14136 - DNA, 20 bp, Artificial Sequence
  Description of Artificial Sequence: Synthetic oligonucleotide
  Target: SOD1; (-) strand; PAM type: YTN; PAM sequence: TTG
tggtatatgttgccctaatt

SEQ ID NO: 14137 - DNA, 20 bp, Artificial Sequence
  Description of Artificial Sequence: Synthetic oligonucleotide
  Target: SOD1; (-) strand; PAM type: YTN; PAM sequence: TTT
gtggtatatgttgccctaat

SEQ ID NO: 14138 - DNA, 20 bp, Artificial Sequence
  Description of Artificial Sequence: Synthetic oligonucleotide
  Target: SOD1; (-) strand; PAM type: YTN; PAM sequence: CTT
tgtggtatatgttgccctaa

SEQ ID NO: 14139 - DNA, 20 bp, Artificial Sequence
  Description of Artificial Sequence: Synthetic oligonucleotide
  Target: SOD1; (-) strand; PAM type: YTN; PAM sequence: TTG
gctttgtggtatatgttgcc

SEQ ID NO: 14140 - DNA, 20 bp, Artificial Sequence
  Description of Artificial Sequence: Synthetic oligonucleotide
  Target: SOD1; (-) strand; PAM type: YTN; PAM sequence: TTC
cattggctttgtggtatatg

SEQ ID NO: 14141 - DNA, 20 bp, Artificial Sequence
  Description of Artificial Sequence: Synthetic oligonucleotide
  Target: SOD1; (-) strand; PAM type: YTN; PAM sequence: TTT
ccattggctttgtggtatat

SEQ ID NO: 14142 - DNA, 20 bp, Artificial Sequence
  Description of Artificial Sequence: Synthetic oligonucleotide
  Target: SOD1; (-) strand; PAM type: YTN; PAM sequence: TTT
tccattggctttgtggtata

SEQ ID NO: 14143 - DNA, 20 bp, Artificial Sequence
  Description of Artificial Sequence: Synthetic oligonucleotide
  Target: SOD1; (-) strand; PAM type: YTN; PAM sequence: TTT
ttccattggctttgtggtat

SEQ ID NO: 14144 - DNA, 20 bp, Artificial Sequence
  Description of Artificial Sequence: Synthetic oligonucleotide
  Target: SOD1; (-) strand; PAM type: YTN; PAM sequence: TTT
tttccattggctttgtggta

SEQ ID NO: 14145 - DNA, 20 bp, Artificial Sequence
  Description of Artificial Sequence: Synthetic oligonucleotide
  Target: SOD1; (-) strand; PAM type: YTN; PAM sequence: TTT
ttttccattggctttgtggt

SEQ ID NO: 14146 - DNA, 20 bp, Artificial Sequence
  Description of Artificial Sequence: Synthetic oligonucleotide
  Target: SOD1; (-) strand; PAM type: YTN; PAM sequence: TTT
tttttccattggctttgtgg

SEQ ID NO: 14147 - DNA, 20 bp, Artificial Sequence
  Description of Artificial Sequence: Synthetic oligonucleotide
  Target: SOD1; (-) strand; PAM type: YTN; PAM sequence: TTT
ttttttccattggctttgtg

SEQ ID NO: 14148 - DNA, 20 bp, Artificial Sequence
  Description of Artificial Sequence: Synthetic oligonucleotide
  Target: SOD1; (-) strand; PAM type: YTN; PAM sequence: CTT
tttttttccattggctttgt

SEQ ID NO: 14149 - DNA, 20 bp, Artificial Sequence
  Description of Artificial Sequence: Synthetic oligonucleotide
  Target: SOD1; (-) strand; PAM type: YTN; PAM sequence: TTC
tttttttttccattggcttt

SEQ ID NO: 14150 - DNA, 20 bp, Artificial Sequence
  Description of Artificial Sequence: Synthetic oligonucleotide
  Target: SOD1; (-) strand; PAM type: YTN; PAM sequence: TTT
ctttttttttccattggctt

SEQ ID NO: 14151 - DNA, 20 bp, Artificial Sequence
  Description of Artificial Sequence: Synthetic oligonucleotide
  Target: SOD1; (-) strand; PAM type: YTN; PAM sequence: TTT
tctttttttttccattggct

SEQ ID NO: 14152 - DNA, 20 bp, Artificial Sequence
  Description of Artificial Sequence: Synthetic oligonucleotide
  Target: SOD1; (-) strand; PAM type: YTN; PAM sequence: TTC
aatcgaggttttcttttttt

SEQ ID NO: 14153 - DNA, 20 bp, Artificial Sequence
  Description of Artificial Sequence: Synthetic oligonucleotide
  Target: SOD1; (-) strand; PAM type: YTN; PAM sequence: TTG
caattcaatcgaggttttct

SEQ ID NO: 14154 - DNA, 20 bp, Artificial Sequence
  Description of Artificial Sequence: Synthetic oligonucleotide
  Target: SOD1; (-) strand; PAM type: YTN; PAM sequence: TTT
gcaattcaatcgaggttttc

SEQ ID NO: 14155 - DNA, 20 bp, Artificial Sequence
  Description of Artificial Sequence: Synthetic oligonucleotide
  Target: SOD1; (-) strand; PAM type: YTN; PAM sequence: CTG
tgtttgcaattcaatcgagg

SEQ ID NO: 14156 - DNA, 20 bp, Artificial Sequence
  Description of Artificial Sequence: Synthetic oligonucleotide
  Target: SOD1; (-) strand; PAM type: YTN; PAM sequence: TTG
aaaagctgtgtttgcaattc

SEQ ID NO: 14157 - DNA, 20 bp, Artificial Sequence
  Description of Artificial Sequence: Synthetic oligonucleotide
  Target: SOD1; (-) strand; PAM type: YTN; PAM sequence: TTA
atgtcaattgaaaagctgtg

SEQ ID NO: 14158 - DNA, 20 bp, Artificial Sequence
  Description of Artificial Sequence: Synthetic oligonucleotide
  Target: SOD1; (-) strand; PAM type: YTN; PAM sequence: TTT
aatgtcaattgaaaagctgt

SEQ ID NO: 14159 - DNA, 20 bp, Artificial Sequence
  Description of Artificial Sequence: Synthetic oligonucleotide
  Target: SOD1; (-) strand; PAM type: YTN; PAM sequence: TTT
taatgtcaattgaaaagctg

SEQ ID NO: 14160 - DNA, 20 bp, Artificial Sequence
  Description of Artificial Sequence: Synthetic oligonucleotide
  Target: SOD1; (-) strand; PAM type: YTN; PAM sequence: TTG
ttttaatgtcaattgaaaag

SEQ ID NO: 14161 - DNA, 20 bp, Artificial Sequence
  Description of Artificial Sequence: Synthetic oligonucleotide
  Target: SOD1; (-) strand; PAM type: YTN; PAM sequence: TTA
gttgttttaatgtcaattga

SEQ ID NO: 14162 - DNA, 20 bp, Artificial Sequence
  Description of Artificial Sequence: Synthetic oligonucleotide
  Target: SOD1; (-) strand; PAM type: YTN; PAM sequence: CTC
agtcataaggtaaaggttag

SEQ ID NO: 14163 - DNA, 20 bp, Artificial Sequence
  Description of Artificial Sequence: Synthetic oligonucleotide
  Target: SOD1; (-) strand; PAM type: YTN; PAM sequence: TTA
gtgctcagtcataaggtaaa

SEQ ID NO: 14164 - DNA, 20 bp, Artificial Sequence
  Description of Artificial Sequence: Synthetic oligonucleotide
  Target: SOD1; (-) strand; PAM type: YTN; PAM sequence: TTT
agtgctcagtcataaggtaa

SEQ ID NO: 14165 - DNA, 20 bp, Artificial Sequence
  Description of Artificial Sequence: Synthetic oligonucleotide
  Target: SOD1; (-) strand; PAM type: YTN; PAM sequence: TTT
tagtgctcagtcataaggta

SEQ ID NO: 14166 - DNA, 20 bp, Artificial Sequence
  Description of Artificial Sequence: Synthetic oligonucleotide
  Target: SOD1; (-) strand; PAM type: YTN; PAM sequence: TTT
ttagtgctcagtcataaggt

SEQ ID NO: 14167 - DNA, 20 bp, Artificial Sequence
  Description of Artificial Sequence: Synthetic oligonucleotide
  Target: SOD1; (-) strand; PAM type: YTN; PAM sequence: TTG
atttttagtgctcagtcata

SEQ ID NO: 14168 - DNA, 20 bp, Artificial Sequence
  Description of Artificial Sequence: Synthetic oligonucleotide
  Target: SOD1; (-) strand; PAM type: YTN; PAM sequence: TTT
gatttttagtgctcagtcat

SEQ ID NO: 14169 - DNA, 20 bp, Artificial Sequence
  Description of Artificial Sequence: Synthetic oligonucleotide
  Target: SOD1; (-) strand; PAM type: YTN; PAM sequence: TTT
tgatttttagtgctcagtca

SEQ ID NO: 14170 - DNA, 20 bp, Artificial Sequence
  Description of Artificial Sequence: Synthetic oligonucleotide
  Target: SOD1; (-) strand; PAM type: YTN; PAM sequence: CTT
ttgatttttagtgctcagtc

SEQ ID NO: 14171 - DNA, 20 bp, Artificial Sequence
  Description of Artificial Sequence: Synthetic oligonucleotide
  Target: SOD1; (-) strand; PAM type: YTN; PAM sequence: TTC
atatgtaatacttttgattt

SEQ ID NO: 14172 - DNA, 20 bp, Artificial Sequence
  Description of Artificial Sequence: Synthetic oligonucleotide
  Target: SOD1; (-) strand; PAM type: YTN; PAM sequence: TTT
catatgtaatacttttgatt

SEQ ID NO: 14173 - DNA, 20 bp, Artificial Sequence
  Description of Artificial Sequence: Synthetic oligonucleotide
  Target: SOD1; (-) strand; PAM type: YTN; PAM sequence: CTT
tcatatgtaatacttttgat

SEQ ID NO: 14174 - DNA, 20 bp, Artificial Sequence
  Description of Artificial Sequence: Synthetic oligonucleotide
  Target: SOD1; (-) strand; PAM type: YTN; PAM sequence: CTC
actttcatatgtaatacttt

SEQ ID NO: 14175 - DNA, 20 bp, Artificial Sequence
  Description of Artificial Sequence: Synthetic oligonucleotide
  Target: SOD1; (-) strand; PAM type: YTN; PAM sequence: TTC
tcactttcatatgtaatact

SEQ ID NO: 14176 - DNA, 20 bp, Artificial Sequence
  Description of Artificial Sequence: Synthetic oligonucleotide
  Target: SOD1; (-) strand; PAM type: YTN; PAM sequence: TTA
ttctcactttcatatgtaat

SEQ ID NO: 14177 - DNA, 20 bp, Artificial Sequence
  Description of Artificial Sequence: Synthetic oligonucleotide
  Target: SOD1; (-) strand; PAM type: YTN; PAM sequence: TTA
tgtagttattctcactttca

SEQ ID NO: 14178 - DNA, 20 bp, Artificial Sequence
  Description of Artificial Sequence: Synthetic oligonucleotide
  Target: SOD1; (-) strand; PAM type: YTN; PAM sequence: TTT
atgtagttattctcactttc

SEQ ID NO: 14179 - DNA, 20 bp, Artificial Sequence
  Description of Artificial Sequence: Synthetic oligonucleotide
  Target: SOD1; (-) strand; PAM type: YTN; PAM sequence: TTT
tatgtagttattctcacttt

SEQ ID NO: 14180 - DNA, 20 bp, Artificial Sequence
  Description of Artificial Sequence: Synthetic oligonucleotide
  Target: SOD1; (-) strand; PAM type: YTN; PAM sequence: TTG
atgaaaatagacattttatg

SEQ ID NO: 14181 - DNA, 20 bp, Artificial Sequence
  Description of Artificial Sequence: Synthetic oligonucleotide
  Target: SOD1; (-) strand; PAM type: YTN; PAM sequence: TTT
gatgaaaatagacattttat

SEQ ID NO: 14182 - DNA, 20 bp, Artificial Sequence
  Description of Artificial Sequence: Synthetic oligonucleotide
  Target: SOD1; (-) strand; PAM type: YTN; PAM sequence: TTA
tttgatgaaaatagacattt

SEQ ID NO: 14183 - DNA, 20 bp, Artificial Sequence
  Description of Artificial Sequence: Synthetic oligonucleotide
  Target: SOD1; (-) strand; PAM type: YTN; PAM sequence: CTT
atttgatgaaaatagacatt

SEQ ID NO: 14184 - DNA, 20 bp, Artificial Sequence
  Description of Artificial Sequence: Synthetic oligonucleotide
  Target: SOD1; (-) strand; PAM type: YTN; PAM sequence: TTA
gacttatttgatgaaaatag

SEQ ID NO: 14185 - DNA, 20 bp, Artificial Sequence
  Description of Artificial Sequence: Synthetic oligonucleotide
  Target: SOD1; (-) strand; PAM type: YTN; PAM sequence: CTA
aattagacttatttgatgaa

SEQ ID NO: 14186 - DNA, 20 bp, Artificial Sequence
  Description of Artificial Sequence: Synthetic oligonucleotide
  Target: SOD1; (-) strand; PAM type: YTN; PAM sequence: TTG
gagtctaaattagacttatt

SEQ ID NO: 14187 - DNA, 20 bp, Artificial Sequence
  Description of Artificial Sequence: Synthetic oligonucleotide
  Target: SOD1; (-) strand; PAM type: YTN; PAM sequence: CTG
tattggagtctaaattagac

SEQ ID NO: 14188 - DNA, 20 bp, Artificial Sequence
  Description of Artificial Sequence: Synthetic oligonucleotide
  Target: SOD1; (-) strand; PAM type: YTN; PAM sequence: TTA
atactgtattggagtctaaa

SEQ ID NO: 14189 - DNA, 20 bp, Artificial Sequence
  Description of Artificial Sequence: Synthetic oligonucleotide
  Target: SOD1; (-) strand; PAM type: YTN; PAM sequence: CTG
ttaatactgtattggagtct

SEQ ID NO: 14190 - DNA, 20 bp, Artificial Sequence
  Description of Artificial Sequence: Synthetic oligonucleotide
  Target: SOD1; (-) strand; PAM type: YTN; PAM sequence: TTG
agctgttaatactgtattgg

SEQ ID NO: 14191 - DNA, 20 bp, Artificial Sequence
  Description of Artificial Sequence: Synthetic oligonucleotide
  Target: SOD1; (-) strand; PAM type: YTN; PAM sequence: TTT
gagctgttaatactgtattg

SEQ ID NO: 14192 - DNA, 20 bp, Artificial Sequence
  Description of Artificial Sequence: Synthetic oligonucleotide
  Target: SOD1; (-) strand; PAM type: YTN; PAM sequence: TTC
accgtcaaagtttgagctgt

SEQ ID NO: 14193 - DNA, 20 bp, Artificial Sequence
  Description of Artificial Sequence: Synthetic oligonucleotide
  Target: SOD1; (-) strand; PAM type: YTN; PAM sequence: TTG
ttcaccgtcaaagtttgagc

SEQ ID NO: 14194 - DNA, 20 bp, Artificial Sequence
  Description of Artificial Sequence: Synthetic oligonucleotide
  Target: SOD1; (-) strand; PAM type: YTN; PAM sequence: TTA
aggtggaaaaggattgttca

SEQ ID NO: 14195 - DNA, 20 bp, Artificial Sequence
  Description of Artificial Sequence: Synthetic oligonucleotide
  Target: SOD1; (-) strand; PAM type: YTN; PAM sequence: CTG
cattaaggtggaaaaggatt

SEQ ID NO: 14196 - DNA, 20 bp, Artificial Sequence
  Description of Artificial Sequence: Synthetic oligonucleotide
  Target: SOD1; (-) strand; PAM type: YTN; PAM sequence: CTA
cactgcattaaggtggaaaa

SEQ ID NO: 14197 - DNA, 20 bp, Artificial Sequence
  Description of Artificial Sequence: Synthetic oligonucleotide
  Target: SOD1; (-) strand; PAM type: YTN; PAM sequence: TTC
ctacactgcattaaggtgga

SEQ ID NO: 14198 - DNA, 20 bp, Artificial Sequence
  Description of Artificial Sequence: Synthetic oligonucleotide
  Target: SOD1; (-) strand; PAM type: YTN; PAM sequence: CTT
cctacactgcattaaggtgg

SEQ ID NO: 14199 - DNA, 20 bp, Artificial Sequence
  Description of Artificial Sequence: Synthetic oligonucleotide
  Target: SOD1; (-) strand; PAM type: YTN; PAM sequence: TTC
ttcctacactgcattaaggt

SEQ ID NO: 14200 - DNA, 20 bp, Artificial Sequence
  Description of Artificial Sequence: Synthetic oligonucleotide
  Target: SOD1; (-) strand; PAM type: YTN; PAM sequence: CTA
ttcttcctacactgcattaa

SEQ ID NO: 14201 - DNA, 20 bp, Artificial Sequence
  Description of Artificial Sequence: Synthetic oligonucleotide
  Target: SOD1; (-) strand; PAM type: YTN; PAM sequence: TTA
atgtgtgctattcttcctac

SEQ ID NO: 14202 - DNA, 20 bp, Artificial Sequence
  Description of Artificial Sequence: Synthetic oligonucleotide
  Target: SOD1; (-) strand; PAM type: YTN; PAM sequence: TTT
aatgtgtgctattcttccta

SEQ ID NO: 14203 - DNA, 20 bp, Artificial Sequence
  Description of Artificial Sequence: Synthetic oligonucleotide
  Target: SOD1; (-) strand; PAM type: YTN; PAM sequence: CTT
taatgtgtgctattcttcct

SEQ ID NO: 14204 - DNA, 20 bp, Artificial Sequence
  Description of Artificial Sequence: Synthetic oligonucleotide
  Target: SOD1; (-) strand; PAM type: YTN; PAM sequence: TTC
gtaacaaactttaatgtgtg

SEQ ID NO: 14205 - DNA, 20 bp, Artificial Sequence
  Description of Artificial Sequence: Synthetic oligonucleotide
  Target: SOD1; (-) strand; PAM type: YTN; PAM sequence: TTT
cgtaacaaactttaatgtgt

SEQ ID NO: 14206 - DNA, 20 bp, Artificial Sequence
  Description of Artificial Sequence: Synthetic oligonucleotide
  Target: SOD1; (-) strand; PAM type: YTN; PAM sequence: TTT
tcgtaacaaactttaatgtg

SEQ ID NO: 14207 - DNA, 20 bp, Artificial Sequence
  Description of Artificial Sequence: Synthetic oligonucleotide
  Target: SOD1; (-) strand; PAM type: YTN; PAM sequence: CTA
ttttcgtaacaaactttaat

SEQ ID NO: 14208 - DNA, 20 bp, Artificial Sequence
  Description of Artificial Sequence: Synthetic oligonucleotide
  Target: SOD1; (-) strand; PAM type: YTN; PAM sequence: CTC
tattttcgtaacaaacttta

SEQ ID NO: 14209 - DNA, 20 bp, Artificial Sequence
  Description of Artificial Sequence: Synthetic oligonucleotide
  Target: SOD1; (-) strand; PAM type: YTN; PAM sequence: TTA
ataaactctattttcgtaac

SEQ ID NO: 14210 - DNA, 20 bp, Artificial Sequence
  Description of Artificial Sequence: Synthetic oligonucleotide
  Target: SOD1; (-) strand; PAM type: YTN; PAM sequence: TTT
aataaactctattttcgtaa

SEQ ID NO: 14211 - DNA, 20 bp, Artificial Sequence
  Description of Artificial Sequence: Synthetic oligonucleotide
  Target: SOD1; (-) strand; PAM type: YTN; PAM sequence: TTT
taataaactctattttcgta

SEQ ID NO: 14212 - DNA, 20 bp, Artificial Sequence
  Description of Artificial Sequence: Synthetic oligonucleotide
  Target: SOD1; (-) strand; PAM type: YTN; PAM sequence: TTT
ttaataaactctattttcgt

SEQ ID NO: 14213 - DNA, 20 bp, Artificial Sequence
  Description of Artificial Sequence: Synthetic oligonucleotide
  Target: SOD1; (-) strand; PAM type: YTN; PAM sequence: CTC
aaaacaatagggatgttttt

SEQ ID NO: 14214 - DNA, 20 bp, Artificial Sequence
  Description of Artificial Sequence: Synthetic oligonucleotide
  Target: SOD1; (-) strand; PAM type: YTN; PAM sequence: CTC
ctcaaaacaatagggatgtt

SEQ ID NO: 14215 - DNA, 20 bp, Artificial Sequence
  Description of Artificial Sequence: Synthetic oligonucleotide
  Target: SOD1; (-) strand; PAM type: YTN; PAM sequence: TTA
agacaaggtaacggtgaaag

SEQ ID NO: 14216 - DNA, 20 bp, Artificial Sequence
  Description of Artificial Sequence: Synthetic oligonucleotide
  Target: SOD1; (-) strand; PAM type: YTN; PAM sequence: TTT
aagacaaggtaacggtgaaa

SEQ ID NO: 14217 - DNA, 20 bp, Artificial Sequence
  Description of Artificial Sequence: Synthetic oligonucleotide
  Target: SOD1; (-) strand; PAM type: YTN; PAM sequence: TTA
atttaagacaaggtaacggt

SEQ ID NO: 14218 - DNA, 20 bp, Artificial Sequence
  Description of Artificial Sequence: Synthetic oligonucleotide
  Target: SOD1; (-) strand; PAM type: YTN; PAM sequence: TTT
aatttaagacaaggtaacgg

SEQ ID NO: 14219 - DNA, 20 bp, Artificial Sequence
  Description of Artificial Sequence: Synthetic oligonucleotide
  Target: SOD1; (-) strand; PAM type: YTN; PAM sequence: TTT
taatttaagacaaggtaacg

SEQ ID NO: 14220 - DNA, 20 bp, Artificial Sequence
  Description of Artificial Sequence: Synthetic oligonucleotide
  Target: SOD1; (-) strand; PAM type: YTN; PAM sequence: TTT
ttaatttaagacaaggtaac

SEQ ID NO: 14221 - DNA, 20 bp, Artificial Sequence
  Description of Artificial Sequence: Synthetic oligonucleotide
  Target: SOD1; (-) strand; PAM type: YTN; PAM sequence: TTT
tttaatttaagacaaggtaa

SEQ ID NO: 14222 - DNA, 20 bp, Artificial Sequence
  Description of Artificial Sequence: Synthetic oligonucleotide
  Target: SOD1; (-) strand; PAM type: YTN; PAM sequence: TTT
ttttaatttaagacaaggta

SEQ ID NO: 14223 - DNA, 20 bp, Artificial Sequence
  Description of Artificial Sequence: Synthetic oligonucleotide
  Target: SOD1; (-) strand; PAM type: YTN; PAM sequence: TTT
tttttaatttaagacaaggt

SEQ ID NO: 14224 - DNA, 20 bp, Artificial Sequence
  Description of Artificial Sequence: Synthetic oligonucleotide
  Target: SOD1; (-) strand; PAM type: YTN; PAM sequence: TTT
ttttttaatttaagacaagg

SEQ ID NO: 14225 - DNA, 20 bp, Artificial Sequence
  Description of Artificial Sequence: Synthetic oligonucleotide
  Target: SOD1; (-) strand; PAM type: YTN; PAM sequence: TTT
tttttttaatttaagacaag

SEQ ID NO: 14226 - DNA, 20 bp, Artificial Sequence
  Description of Artificial Sequence: Synthetic oligonucleotide
  Target: SOD1; (-) strand; PAM type: YTN; PAM sequence: TTT
ttttttttaatttaagacaa

SEQ ID NO: 14227 - DNA, 20 bp, Artificial Sequence
  Description of Artificial Sequence: Synthetic oligonucleotide
  Target: SOD1; (-) strand; PAM type: YTN; PAM sequence: TTT
tttttttttaatttaagaca

SEQ ID NO: 14228 - DNA, 20 bp, Artificial Sequence
  Description of Artificial Sequence: Synthetic oligonucleotide
  Target: SOD1; (-) strand; PAM type: YTN; PAM sequence: TTT
ttttttttttaatttaagac

SEQ ID NO: 14229 - DNA, 20 bp, Artificial Sequence
  Description of Artificial Sequence: Synthetic oligonucleotide
  Target: SOD1; (-) strand; PAM type: YTN; PAM sequence: TTT
tttttttttttaatttaaga

SEQ ID NO: 14230 - DNA, 20 bp, Artificial Sequence
  Description of Artificial Sequence: Synthetic oligonucleotide
  Target: SOD1; (-) strand; PAM type: YTN; PAM sequence: TTT
ttttttttttttaatttaag

SEQ ID NO: 14231 - DNA, 20 bp, Artificial Sequence
  Description of Artificial Sequence: Synthetic oligonucleotide
  Target: SOD1; (-) strand; PAM type: YTN; PAM sequence: TTT
tttttttttttttaatttaa

SEQ ID NO: 14232 - DNA, 20 bp, Artificial Sequence
  Description of Artificial Sequence: Synthetic oligonucleotide
  Target: SOD1; (-) strand; PAM type: YTN; PAM sequence: TTT
ttttttttttttttaattta

SEQ ID NO: 14233 - DNA, 20 bp, Artificial Sequence
  Description of Artificial Sequence: Synthetic oligonucleotide
  Target: SOD1; (-) strand; PAM type: YTN; PAM sequence: CTA
tttttttttttttttttaat

SEQ ID NO: 14234 - DNA, 20 bp, Artificial Sequence
  Description of Artificial Sequence: Synthetic oligonucleotide
  Target: SOD1; (-) strand; PAM type: YTN; PAM sequence: CTC
tattttttttttttttttta

SEQ ID NO: 14235 - DNA, 20 bp, Artificial Sequence
  Description of Artificial Sequence: Synthetic oligonucleotide
  Target: SOD1; (-) strand; PAM type: YTN; PAM sequence: CTC
tctatttttttttttttttt

SEQ ID NO: 14236 - DNA, 20 bp, Artificial Sequence
  Description of Artificial Sequence: Synthetic oligonucleotide
  Target: SOD1; (-) strand; PAM type: YTN; PAM sequence: TTA
gaagtgctctctattttttt

SEQ ID NO: 14237 - DNA, 20 bp, Artificial Sequence
  Description of Artificial Sequence: Synthetic oligonucleotide
  Target: SOD1; (-) strand; PAM type: YTN; PAM sequence: TTA
caaatcgtaattagaagtgc

SEQ ID NO: 14238 - DNA, 20 bp, Artificial Sequence
  Description of Artificial Sequence: Synthetic oligonucleotide
  Target: SOD1; (-) strand; PAM type: YTN; PAM sequence: TTT
acaaatcgtaattagaagtg

SEQ ID NO: 14239 - DNA, 20 bp, Artificial Sequence
  Description of Artificial Sequence: Synthetic oligonucleotide
  Target: SOD1; (-) strand; PAM type: YTN; PAM sequence: TTA
aaaagtttacaaatcgtaat

SEQ ID NO: 14240 - DNA, 20 bp, Artificial Sequence
  Description of Artificial Sequence: Synthetic oligonucleotide
  Target: SOD1; (-) strand; PAM type: YTN; PAM sequence: TTT
aaaaagtttacaaatcgtaa

SEQ ID NO: 14241 - DNA, 20 bp, Artificial Sequence
  Description of Artificial Sequence: Synthetic oligonucleotide
  Target: SOD1; (-) strand; PAM type: YTN; PAM sequence: CTT
taaaaagtttacaaatcgta

SEQ ID NO: 14242 - DNA, 20 bp, Artificial Sequence
  Description of Artificial Sequence: Synthetic oligonucleotide
  Target: SOD1; (-) strand; PAM type: YTN; PAM sequence: TTG
actttaaaaagtttacaaat

SEQ ID NO: 14243 - DNA, 20 bp, Artificial Sequence
  Description of Artificial Sequence: Synthetic oligonucleotide
  Target: SOD1; (-) strand; PAM type: YTN; PAM sequence: TTT
gactttaaaaagtttacaaa

SEQ ID NO: 14244 - DNA, 20 bp, Artificial Sequence
  Description of Artificial Sequence: Synthetic oligonucleotide
  Target: SOD1; (-) strand; PAM type: YTN; PAM sequence: TTT
tgactttaaaaagtttacaa

SEQ ID NO: 14245 - DNA, 20 bp, Artificial Sequence
  Description of Artificial Sequence: Synthetic oligonucleotide
  Target: SOD1; (-) strand; PAM type: YTN; PAM sequence: TTA
aaagttttgactttaaaaag

SEQ ID NO: 14246 - DNA, 20 bp, Artificial Sequence
  Description of Artificial Sequence: Synthetic oligonucleotide
  Target: SOD1; (-) strand; PAM type: YTN; PAM sequence: TTT
aaaagttttgactttaaaaa

SEQ ID NO: 14247 - DNA, 20 bp, Artificial Sequence
  Description of Artificial Sequence: Synthetic oligonucleotide
  Target: SOD1; (-) strand; PAM type: YTN; PAM sequence: TTT
taaaagttttgactttaaaa

SEQ ID NO: 14248 - DNA, 20 bp, Artificial Sequence
  Description of Artificial Sequence: Synthetic oligonucleotide
  Target: SOD1; (-) strand; PAM type: YTN; PAM sequence: TTT
ttaaaagttttgactttaaa

SEQ ID NO: 14249 - DNA, 20 bp, Artificial Sequence
  Description of Artificial Sequence: Synthetic oligonucleotide
  Target: SOD1; (-) strand; PAM type: YTN; PAM sequence: CTT
tttaaaagttttgactttaa

SEQ ID NO: 14250 - DNA, 20 bp, Artificial Sequence
  Description of Artificial Sequence: Synthetic oligonucleotide
  Target: SOD1; (-) strand; PAM type: YTN; PAM sequence: CTG
taactttttaaaagttttga

SEQ ID NO: 14251 - DNA, 20 bp, Artificial Sequence
  Description of Artificial Sequence: Synthetic oligonucleotide
  Target: SOD1; (-) strand; PAM type: YTN; PAM sequence: TTG
ctgtaactttttaaaagttt

SEQ ID NO: 14252 - DNA, 20 bp, Artificial Sequence
  Description of Artificial Sequence: Synthetic oligonucleotide
  Target: SOD1; (-) strand; PAM type: YTN; PAM sequence: TTT
gctgtaactttttaaaagtt

SEQ ID NO: 14253 - DNA, 20 bp, Artificial Sequence
  Description of Artificial Sequence: Synthetic oligonucleotide
  Target: SOD1; (-) strand; PAM type: YTN; PAM sequence: TTT
tgctgtaactttttaaaagt

SEQ ID NO: 14254 - DNA, 20 bp, Artificial Sequence
  Description of Artificial Sequence: Synthetic oligonucleotide
  Target: SOD1; (-) strand; PAM type: YTN; PAM sequence: TTT
ttgctgtaactttttaaaag

SEQ ID NO: 14255 - DNA, 20 bp, Artificial Sequence
  Description of Artificial Sequence: Synthetic oligonucleotide
  Target: SOD1; (-) strand; PAM type: YTN; PAM sequence: CTT
tttgctgtaactttttaaaa

SEQ ID NO: 14256 - DNA, 20 bp, Artificial Sequence
  Description of Artificial Sequence: Synthetic oligonucleotide
  Target: SOD1; (-) strand; PAM type: YTN; PAM sequence: TTA
ccctttttgctgtaactttt

SEQ ID NO: 14257 - DNA, 20 bp, Artificial Sequence
  Description of Artificial Sequence: Synthetic oligonucleotide
  Target: SOD1; (-) strand; PAM type: YTN; PAM sequence: CTG
aaaatatgaataaatattac

SEQ ID NO: 14258 - DNA, 20 bp, Artificial Sequence
  Description of Artificial Sequence: Synthetic oligonucleotide
  Target: SOD1; (-) strand; PAM type: YTN; PAM sequence: TTA
aaaatagccacaaaataaca

SEQ ID NO: 14259 - DNA, 20 bp, Artificial Sequence
  Description of Artificial Sequence: Synthetic oligonucleotide
  Target: SOD1; (-) strand; PAM type: YTN; PAM sequence: TTT
aaaaatagccacaaaataac

SEQ ID NO: 14260 - DNA, 20 bp, Artificial Sequence
  Description of Artificial Sequence: Synthetic oligonucleotide
  Target: SOD1; (-) strand; PAM type: YTN; PAM sequence: CTA
tttaaaaatagccacaaaat

SEQ ID NO: 14261 - DNA, 20 bp, Artificial Sequence
  Description of Artificial Sequence: Synthetic oligonucleotide
  Target: SOD1; (-) strand; PAM type: YTN; PAM sequence: TTC
tatttaaaaatagccacaaa

SEQ ID NO: 14262 - DNA, 20 bp, Artificial Sequence
  Description of Artificial Sequence: Synthetic oligonucleotide
  Target: SOD1; (-) strand; PAM type: YTN; PAM sequence: CTT
ctatttaaaaatagccacaa

SEQ ID NO: 14263 - DNA, 20 bp, Artificial Sequence
  Description of Artificial Sequence: Synthetic oligonucleotide
  Target: SOD1; (-) strand; PAM type: YTN; PAM sequence: TTC
ccttctatttaaaaatagcc

SEQ ID NO: 14264 - DNA, 20 bp, Artificial Sequence
  Description of Artificial Sequence: Synthetic oligonucleotide
  Target: SOD1; (-) strand; PAM type: YTN; PAM sequence: CTT
cccttctatttaaaaatagc

SEQ ID NO: 14265 - DNA, 20 bp, Artificial Sequence
  Description of Artificial Sequence: Synthetic oligonucleotide
  Target: SOD1; (-) strand; PAM type: YTN; PAM sequence: TTG
cttcccttctatttaaaaat

SEQ ID NO: 14266 - DNA, 20 bp, Artificial Sequence
  Description of Artificial Sequence: Synthetic oligonucleotide
  Target: SOD1; (-) strand; PAM type: YTN; PAM sequence: TTG
attgcttcccttctatttaa

SEQ ID NO: 14267 - DNA, 20 bp, Artificial Sequence
  Description of Artificial Sequence: Synthetic oligonucleotide
  Target: SOD1; (-) strand; PAM type: YTN; PAM sequence: TTT
gattgcttcccttctattta

SEQ ID NO: 14268 - DNA, 20 bp, Artificial Sequence
  Description of Artificial Sequence: Synthetic oligonucleotide
  Target: SOD1; (-) strand; PAM type: YTN; PAM sequence: CTG
taagcaatttgattgcttcc

SEQ ID NO: 14269 - DNA, 20 bp, Artificial Sequence
  Description of Artificial Sequence: Synthetic oligonucleotide
  Target: SOD1; (-) strand; PAM type: YTN; PAM sequence: CTG
gtggggaactgtaagcaatt

SEQ ID NO: 14270 - DNA, 20 bp, Artificial Sequence
  Description of Artificial Sequence: Synthetic oligonucleotide
  Target: SOD1; (-) strand; PAM type: YTN; PAM sequence: CTG
cagccccgcgccagctggtg

SEQ ID NO: 14271 - DNA, 20 bp, Artificial Sequence
  Description of Artificial Sequence: Synthetic oligonucleotide
  Target: SOD1; (-) strand; PAM type: YTN; PAM sequence: CTG
tactgcagccccgcgccagc

SEQ ID NO: 14272 - DNA, 20 bp, Artificial Sequence
  Description of Artificial Sequence: Synthetic oligonucleotide
  Target: SOD1; (-) strand; PAM type: YTN; PAM sequence: CTC
ccgctgtactgcagccccgc

SEQ ID NO: 14273 - DNA, 20 bp, Artificial Sequence
  Description of Artificial Sequence: Synthetic oligonucleotide
  Target: SOD1; (-) strand; PAM type: YTN; PAM sequence: TTA
tatccgctcccgctgtactg

SEQ ID NO: 14274 - DNA, 20 bp, Artificial Sequence
  Description of Artificial Sequence: Synthetic oligonucleotide
  Target: SOD1; (-) strand; PAM type: YTN; PAM sequence: CTG
tattatatccgctcccgctg

SEQ ID NO: 14275 - DNA, 20 bp, Artificial Sequence
  Description of Artificial Sequence: Synthetic oligonucleotide
  Target: SOD1; (-) strand; PAM type: YTN; PAM sequence: TTG
aggtgtacagatgctgtatt

SEQ ID NO: 14276 - DNA, 20 bp, Artificial Sequence
  Description of Artificial Sequence: Synthetic oligonucleotide
  Target: SOD1; (-) strand; PAM type: YTN; PAM sequence: CTT
gaggtgtacagatgctgtat

SEQ ID NO: 14277 - DNA, 20 bp, Artificial Sequence
  Description of Artificial Sequence: Synthetic oligonucleotide
  Target: SOD1; (-) strand; PAM type: YTN; PAM sequence: CTG
gagtgtagagcttgaggtgt

SEQ ID NO: 14278 - DNA, 20 bp, Artificial Sequence
  Description of Artificial Sequence: Synthetic oligonucleotide
  Target: SOD1; (-) strand; PAM type: YTN; PAM sequence: TTC
ctggagtgtagagcttgagg

SEQ ID NO: 14279 - DNA, 20 bp, Artificial Sequence
  Description of Artificial Sequence: Synthetic oligonucleotide
  Target: SOD1; (-) strand; PAM type: YTN; PAM sequence: CTT
cctggagtgtagagcttgag

SEQ ID NO: 14280 - DNA, 20 bp, Artificial Sequence
  Description of Artificial Sequence: Synthetic oligonucleotide
  Target: SOD1; (-) strand; PAM type: YTN; PAM sequence: TTG
tgaaaatgtgacagtgacac

SEQ ID NO: 14281 - DNA, 20 bp, Artificial Sequence
  Description of Artificial Sequence: Synthetic oligonucleotide
  Target: SOD1; (-) strand; PAM type: YTN; PAM sequence: TTT
gtgaaaatgtgacagtgaca

SEQ ID NO: 14282 - DNA, 20 bp, Artificial Sequence
  Description of Artificial Sequence: Synthetic oligonucleotide
  Target: SOD1; (-) strand; PAM type: YTN; PAM sequence: CTG
gaatttgtgaaaatgtgaca

SEQ ID NO: 14283 - DNA, 20 bp, Artificial Sequence
  Description of Artificial Sequence: Synthetic oligonucleotide
  Target: SOD1; (-) strand; PAM type: YTN; PAM sequence: TTA
gagactggaatttgtgaaaa

SEQ ID NO: 14284 - DNA, 20 bp, Artificial Sequence
  Description of Artificial Sequence: Synthetic oligonucleotide
  Target: SOD1; (-) strand; PAM type: YTN; PAM sequence: CTC
gttagagactggaatttgtg

SEQ ID NO: 14285 - DNA, 20 bp, Artificial Sequence
  Description of Artificial Sequence: Synthetic oligonucleotide
  Target: SOD1; (-) strand; PAM type: YTN; PAM sequence: CTC
ctcgttagagactggaattt

SEQ ID NO: 14286 - DNA, 20 bp, Artificial Sequence
  Description of Artificial Sequence: Synthetic oligonucleotide
  Target: SOD1; (-) strand; PAM type: YTN; PAM sequence: CTC
agcagcagaggctcctcgtt

SEQ ID NO: 14287 - DNA, 20 bp, Artificial Sequence
  Description of Artificial Sequence: Synthetic oligonucleotide
  Target: SOD1; (-) strand; PAM type: YTN; PAM sequence: CTG
gctcagcagcagaggctcct

SEQ ID NO: 14288 - DNA, 20 bp, Artificial Sequence
  Description of Artificial Sequence: Synthetic oligonucleotide
  Target: SOD1; (-) strand; PAM type: YTN; PAM sequence: TTC
tggctcagcagcagaggctc

SEQ ID NO: 14289 - DNA, 20 bp, Artificial Sequence
  Description of Artificial Sequence: Synthetic oligonucleotide
  Target: SOD1; (-) strand; PAM type: YTN; PAM sequence: TTG
aacccgaaaaggattctggc

SEQ ID NO: 14290 - DNA, 20 bp, Artificial Sequence
  Description of Artificial Sequence: Synthetic oligonucleotide
  Target: SOD1; (-) strand; PAM type: YTN; PAM sequence: CTC
atccgttgaacccgaaaagg

SEQ ID NO: 14291 - DNA, 20 bp, Artificial Sequence
  Description of Artificial Sequence: Synthetic oligonucleotide
  Target: SOD1; (-) strand; PAM type: YTN; PAM sequence: CTA
cctcatccgttgaacccgaa

SEQ ID NO: 14292 - DNA, 20 bp, Artificial Sequence
  Description of Artificial Sequence: Synthetic oligonucleotide
  Target: SOD1; (-) strand; PAM type: YTN; PAM sequence: CTG
aggctacctcatccgttgaa

SEQ ID NO: 14293 - DNA, 20 bp, Artificial Sequence
  Description of Artificial Sequence: Synthetic oligonucleotide
  Target: SOD1; (-) strand; PAM type: YTN; PAM sequence: CTG
ctgaggctacctcatccgtt

SEQ ID NO: 14294 - DNA, 20 bp, Artificial Sequence
  Description of Artificial Sequence: Synthetic oligonucleotide
  Target: SOD1; (-) strand; PAM type: YTN; PAM sequence: TTA
cctgctgaggctacctcatc

SEQ ID NO: 14295 - DNA, 20 bp, Artificial Sequence
  Description of Artificial Sequence: Synthetic oligonucleotide
  Target: SOD1; (-) strand; PAM type: YTN; PAM sequence: CTG
aagagttacctgctgaggct

SEQ ID NO: 14296 - DNA, 20 bp, Artificial Sequence
  Description of Artificial Sequence: Synthetic oligonucleotide
  Target: SOD1; (-) strand; PAM type: YTN; PAM sequence: TTC
tgaagagttacctgctgagg

SEQ ID NO: 14297 - DNA, 20 bp, Artificial Sequence
  Description of Artificial Sequence: Synthetic oligonucleotide
  Target: SOD1; (-) strand; PAM type: YTN; PAM sequence: CTT
ctgaagagttacctgctgag

SEQ ID NO: 14298 - DNA, 20 bp, Artificial Sequence
  Description of Artificial Sequence: Synthetic oligonucleotide
  Target: SOD1; (-) strand; PAM type: YTN; PAM sequence: CTA
aagccttctgaagagttacc

SEQ ID NO: 14299 - DNA, 20 bp, Artificial Sequence
  Description of Artificial Sequence: Synthetic oligonucleotide
  Target: SOD1; (-) strand; PAM type: YTN; PAM sequence: CTG
cagtcctaaagccttctgaa

SEQ ID NO: 14300 - DNA, 20 bp, Artificial Sequence
  Description of Artificial Sequence: Synthetic oligonucleotide
  Target: SOD1; (-) strand; PAM type: YTN; PAM sequence: CTG
aggctgcagtcctaaagcct

SEQ ID NO: 14301 - DNA, 20 bp, Artificial Sequence
  Description of Artificial Sequence: Synthetic oligonucleotide
  Target: SOD1; (-) strand; PAM type: YTN; PAM sequence: TTG
agaagggggtgtctgaggct

SEQ ID NO: 14302 - DNA, 20 bp, Artificial Sequence
  Description of Artificial Sequence: Synthetic oligonucleotide
  Target: SOD1; (-) strand; PAM type: YTN; PAM sequence: CTT
gagaagggggtgtctgaggc

SEQ ID NO: 14303 - DNA, 20 bp, Artificial Sequence
  Description of Artificial Sequence: Synthetic oligonucleotide
  Target: SOD1; (-) strand; PAM type: YTN; PAM sequence: TTC
agaacttgagaagggggtgt

SEQ ID NO: 14304 - DNA, 20 bp, Artificial Sequence
  Description of Artificial Sequence: Synthetic oligonucleotide
  Target: SOD1; (-) strand; PAM type: YTN; PAM sequence: CTT
cagaacttgagaagggggtg

SEQ ID NO: 14305 - DNA, 20 bp, Artificial Sequence
  Description of Artificial Sequence: Synthetic oligonucleotide
  Target: SOD1; (-) strand; PAM type: YTN; PAM sequence: CTG
cttcagaacttgagaagggg

SEQ ID NO: 14306 - DNA, 20 bp, Artificial Sequence
  Description of Artificial Sequence: Synthetic oligonucleotide
  Target: SOD1; (-) strand; PAM type: YTN; PAM sequence: TTA
gccaagtgggaaatgtagac

SEQ ID NO: 14307 - DNA, 20 bp, Artificial Sequence
  Description of Artificial Sequence: Synthetic oligonucleotide
  Target: SOD1; (-) strand; PAM type: YTN; PAM sequence: CTC
ccattagccaagtgggaaat

SEQ ID NO: 14308 - DNA, 20 bp, Artificial Sequence
  Description of Artificial Sequence: Synthetic oligonucleotide
  Target: SOD1; (-) strand; PAM type: YTN; PAM sequence: TTG
aacctcccattagccaagtg

SEQ ID NO: 14309 - DNA, 20 bp, Artificial Sequence
  Description of Artificial Sequence: Synthetic oligonucleotide
  Target: SOD1; (-) strand; PAM type: YTN; PAM sequence: CTG
aggtgacagacagggcaggt

SEQ ID NO: 14310 - DNA, 20 bp, Artificial Sequence
  Description of Artificial Sequence: Synthetic oligonucleotide
  Target: SOD1; (-) strand; PAM type: YTN; PAM sequence: CTC
gtagagagaaggaagaagcc

SEQ ID NO: 14311 - DNA, 20 bp, Artificial Sequence
  Description of Artificial Sequence: Synthetic oligonucleotide
  Target: SOD1; (-) strand; PAM type: YTN; PAM sequence: CTA
gagatagagagtctcgtaga

SEQ ID NO: 14312 - DNA, 20 bp, Artificial Sequence
  Description of Artificial Sequence: Synthetic oligonucleotide
  Target: SOD1; (-) strand; PAM type: YTN; PAM sequence: TTC
tagagatagagagtctcgta

SEQ ID NO: 14313 - DNA, 20 bp, Artificial Sequence
  Description of Artificial Sequence: Synthetic oligonucleotide
  Target: SOD1; (-) strand; PAM type: YTN; PAM sequence: CTA
gtgggcatcgagacagagag

SEQ ID NO: 14314 - DNA, 20 bp, Artificial Sequence
  Description of Artificial Sequence: Synthetic oligonucleotide
  Target: SOD1; (-) strand; PAM type: YTN; PAM sequence: CTC
tagtgggcatcgagacagag

SEQ ID NO: 14315 - DNA, 20 bp, Artificial Sequence
  Description of Artificial Sequence: Synthetic oligonucleotide
  Target: SOD1; (-) strand; PAM type: YTN; PAM sequence: TTG
gaagagagaaatagacgctc

SEQ ID NO: 14316 - DNA, 20 bp, Artificial Sequence
  Description of Artificial Sequence: Synthetic oligonucleotide
  Target: SOD1; (-) strand; PAM type: YTN; PAM sequence: CTT
ggaagagagaaatagacgct

SEQ ID NO: 14317 - DNA, 20 bp, Artificial Sequence
  Description of Artificial Sequence: Synthetic oligonucleotide
  Target: SOD1; (-) strand; PAM type: YTN; PAM sequence: CTG
accgggacaggcacagagac

SEQ ID NO: 14318 - DNA, 20 bp, Artificial Sequence
  Description of Artificial Sequence: Synthetic oligonucleotide
  Target: SOD1; (-) strand; PAM type: YTN; PAM sequence: TTG
gaaatagggtggaaaatgac

SEQ ID NO: 14319 - DNA, 20 bp, Artificial Sequence
  Description of Artificial Sequence: Synthetic oligonucleotide
  Target: SOD1; (-) strand; PAM type: YTN; PAM sequence: TTT
ggaaatagggtggaaaatga

SEQ ID NO: 14320 - DNA, 20 bp, Artificial Sequence
  Description of Artificial Sequence: Synthetic oligonucleotide
  Target: SOD1; (-) strand; PAM type: YTN; PAM sequence: TTT
tggaaatagggtggaaaatg

SEQ ID NO: 14321 - DNA, 20 bp, Artificial Sequence
  Description of Artificial Sequence: Synthetic oligonucleotide
  Target: SOD1; (-) strand; PAM type: YTN; PAM sequence: CTT
ttggaaatagggtggaaaat

SEQ ID NO: 14322 - DNA, 20 bp, Artificial Sequence
  Description of Artificial Sequence: Synthetic oligonucleotide
  Target: SOD1; (-) strand; PAM type: YTN; PAM sequence: TTG
gaagaagatcttttggaaat

SEQ ID NO: 14323 - DNA, 20 bp, Artificial Sequence
  Description of Artificial Sequence: Synthetic oligonucleotide
  Target: SOD1; (-) strand; PAM type: YTN; PAM sequence: TTT
ggaagaagatcttttggaaa

SEQ ID NO: 14324 - DNA, 20 bp, Artificial Sequence
  Description of Artificial Sequence: Synthetic oligonucleotide
  Target: SOD1; (-) strand; PAM type: YTN; PAM sequence: TTC
aggtagagaccaagaaaggt

SEQ ID NO: 14325 - DNA, 20 bp, Artificial Sequence
  Description of Artificial Sequence: Synthetic oligonucleotide
  Target: SOD1; (-) strand; PAM type: YTN; PAM sequence: TTC
aattcaggtagagaccaaga

SEQ ID NO: 14326 - DNA, 20 bp, Artificial Sequence
  Description of Artificial Sequence: Synthetic oligonucleotide
  Target: SOD1; (-) strand; PAM type: YTN; PAM sequence: TTA
gaaatgataacaggcagcag

SEQ ID NO: 14327 - DNA, 20 bp, Artificial Sequence
  Description of Artificial Sequence: Synthetic oligonucleotide
  Target: SOD1; (-) strand; PAM type: YTN; PAM sequence: TTT
agaaatgataacaggcagca

SEQ ID NO: 14328 - DNA, 20 bp, Artificial Sequence
  Description of Artificial Sequence: Synthetic oligonucleotide
  Target: SOD1; (-) strand; PAM type: YTN; PAM sequence: CTC
caccaacacagcagcagcca

SEQ ID NO: 14329 - DNA, 20 bp, Artificial Sequence
  Description of Artificial Sequence: Synthetic oligonucleotide
  Target: SOD1; (-) strand; PAM type: YTN; PAM sequence: CTG
aagacagagacggaaggcaa

SEQ ID NO: 14330 - DNA, 20 bp, Artificial Sequence
  Description of Artificial Sequence: Synthetic oligonucleotide
  Target: SOD1; (-) strand; PAM type: YTN; PAM sequence: CTC
gggggcccagggccaggccc

SEQ ID NO: 14331 - DNA, 20 bp, Artificial Sequence
  Description of Artificial Sequence: Synthetic oligonucleotide
  Target: SOD1; (-) strand; PAM type: YTN; PAM sequence: CTG
gtggaatgccagggctcggg

SEQ ID NO: 14332 - DNA, 20 bp, Artificial Sequence
  Description of Artificial Sequence: Synthetic oligonucleotide
  Target: SOD1; (-) strand; PAM type: YTN; PAM sequence: TTA
ggcctggtggaatgccaggg

SEQ ID NO: 14333 - DNA, 20 bp, Artificial Sequence
  Description of Artificial Sequence: Synthetic oligonucleotide
  Target: SOD1; (-) strand; PAM type: YTN; PAM sequence: TTG
ttaggcctggtggaatgcca

SEQ ID NO: 14334 - DNA, 20 bp, Artificial Sequence
  Description of Artificial Sequence: Synthetic oligonucleotide
  Target: SOD1; (-) strand; PAM type: YTN; PAM sequence: TTT
gttaggcctggtggaatgcc

SEQ ID NO: 14335 - DNA, 20 bp, Artificial Sequence
  Description of Artificial Sequence: Synthetic oligonucleotide
  Target: SOD1; (-) strand; PAM type: YTN; PAM sequence: CTT
tgttaggcctggtggaatgc

SEQ ID NO: 14336 - DNA, 20 bp, Artificial Sequence
  Description of Artificial Sequence: Synthetic oligonucleotide
  Target: SOD1; (-) strand; PAM type: YTN; PAM sequence: TTC
ccaccgcatggcccctttgt

SEQ ID NO: 14337 - DNA, 20 bp, Artificial Sequence
  Description of Artificial Sequence: Synthetic oligonucleotide
  Target: SOD1; (-) strand; PAM type: YTN; PAM sequence: CTT
cccaccgcatggcccctttg

SEQ ID NO: 14338 - DNA, 20 bp, Artificial Sequence
  Description of Artificial Sequence: Synthetic oligonucleotide
  Target: SOD1; (-) strand; PAM type: YTN; PAM sequence: CTC
atggaatgaaaggtcccttc

SEQ ID NO: 14339 - DNA, 20 bp, Artificial Sequence
  Description of Artificial Sequence: Synthetic oligonucleotide
  Target: SOD1; (-) strand; PAM type: YTN; PAM sequence: CTC
cacctcatggaatgaaaggt

SEQ ID NO: 14340 - DNA, 20 bp, Artificial Sequence
  Description of Artificial Sequence: Synthetic oligonucleotide
  Target: SOD1; (-) strand; PAM type: YTN; PAM sequence: TTG
cgatgcctccacctcatgga

SEQ ID NO: 14341 - DNA, 20 bp, Artificial Sequence
  Description of Artificial Sequence: Synthetic oligonucleotide
  Target: SOD1; (-) strand; PAM type: YTN; PAM sequence: TTT
gcgatgcctccacctcatgg

SEQ ID NO: 14342 - DNA, 20 bp, Artificial Sequence
  Description of Artificial Sequence: Synthetic oligonucleotide
  Target: SOD1; (-) strand; PAM type: YTN; PAM sequence: CTT
tgcgatgcctccacctcatg

SEQ ID NO: 14343 - DNA, 20 bp, Artificial Sequence
  Description of Artificial Sequence: Synthetic oligonucleotide
  Target: SOD1; (-) strand; PAM type: YTN; PAM sequence: TTG
atgccgccccgtcccatgcc

SEQ ID NO: 14344 - DNA, 20 bp, Artificial Sequence
  Description of Artificial Sequence: Synthetic oligonucleotide
  Target: SOD1; (-) strand; PAM type: YTN; PAM sequence: TTT
gatgccgccccgtcccatgc

SEQ ID NO: 14345 - DNA, 20 bp, Artificial Sequence
  Description of Artificial Sequence: Synthetic oligonucleotide
  Target: SOD1; (-) strand; PAM type: YTN; PAM sequence: CTT
tgatgccgccccgtcccatg

SEQ ID NO: 14346 - DNA, 20 bp, Artificial Sequence
  Description of Artificial Sequence: Synthetic oligonucleotide
  Target: SOD1; (-) strand; PAM type: YTN; PAM sequence: TTC
cctttgatgccgccccgtcc

SEQ ID NO: 14347 - DNA, 20 bp, Artificial Sequence
  Description of Artificial Sequence: Synthetic oligonucleotide
  Target: SOD1; (-) strand; PAM type: YTN; PAM sequence: TTA
cagcggttccctttgatgcc

SEQ ID NO: 14348 - DNA, 20 bp, Artificial Sequence
  Description of Artificial Sequence: Synthetic oligonucleotide
  Target: SOD1; (-) strand; PAM type: YTN; PAM sequence: CTT
acagcggttccctttgatgc

SEQ ID NO: 14349 - DNA, 20 bp, Artificial Sequence
  Description of Artificial Sequence: Synthetic oligonucleotide
  Target: SOD1; (-) strand; PAM type: YTN; PAM sequence: CTC
acttacagcggttccctttg

SEQ ID NO: 14350 - DNA, 20 bp, Artificial Sequence
  Description of Artificial Sequence: Synthetic oligonucleotide
  Target: SOD1; (-) strand; PAM type: YTN; PAM sequence: CTC
caggaatgcccccacctcac

SEQ ID NO: 14351 - DNA, 20 bp, Artificial Sequence
  Description of Artificial Sequence: Synthetic oligonucleotide
  Target: SOD1; (-) strand; PAM type: YTN; PAM sequence: CTC
cagcgccctccaggaatgcc

SEQ ID NO: 14352 - DNA, 20 bp, Artificial Sequence
  Description of Artificial Sequence: Synthetic oligonucleotide
  Target: SOD1; (-) strand; PAM type: YTN; PAM sequence: CTC
atcccactccagcgccctcc

SEQ ID NO: 14353 - DNA, 20 bp, Artificial Sequence
  Description of Artificial Sequence: Synthetic oligonucleotide
  Target: SOD1; (-) strand; PAM type: YTN; PAM sequence: TTG
gcgcccggcccggtctcatc

SEQ ID NO: 14354 - DNA, 20 bp, Artificial Sequence
  Description of Artificial Sequence: Synthetic oligonucleotide
  Target: SOD1; (-) strand; PAM type: YTN; PAM sequence: CTT
ggcgcccggcccggtctcat

SEQ ID NO: 14355 - DNA, 20 bp, Artificial Sequence
  Description of Artificial Sequence: Synthetic oligonucleotide
  Target: SOD1; (-) strand; PAM type: YTN; PAM sequence: TTC
ttggcgcccggcccggtctc

SEQ ID NO: 14356 - DNA, 20 bp, Artificial Sequence
  Description of Artificial Sequence: Synthetic oligonucleotide
  Target: SOD1; (-) strand; PAM type: YTN; PAM sequence: CTT
cttggcgcccggcccggtct

SEQ ID NO: 14357 - DNA, 20 bp, Artificial Sequence
  Description of Artificial Sequence: Synthetic oligonucleotide
  Target: SOD1; (-) strand; PAM type: YTN; PAM sequence: CTG
gtcttcttggcgcccggccc

SEQ ID NO: 14358 - DNA, 20 bp, Artificial Sequence
  Description of Artificial Sequence: Synthetic oligonucleotide
  Target: SOD1; (-) strand; PAM type: YTN; PAM sequence: CTA
ctggtcttcttggcgcccgg

SEQ ID NO: 14359 - DNA, 20 bp, Artificial Sequence
  Description of Artificial Sequence: Synthetic oligonucleotide
  Target: SOD1; (-) strand; PAM type: YTN; PAM sequence: TTC
aggcaccatctactggtctt

SEQ ID NO: 14360 - DNA, 20 bp, Artificial Sequence
  Description of Artificial Sequence: Synthetic oligonucleotide
  Target: SOD1; (-) strand; PAM type: YTN; PAM sequence: CTT
caggcaccatctactggtct

SEQ ID NO: 14361 - DNA, 20 bp, Artificial Sequence
  Description of Artificial Sequence: Synthetic oligonucleotide
  Target: SOD1; (-) strand; PAM type: YTN; PAM sequence: TTG
gacttcaggcaccatctact

SEQ ID NO: 14362 - DNA, 20 bp, Artificial Sequence
  Description of Artificial Sequence: Synthetic oligonucleotide
  Target: SOD1; (-) strand; PAM type: YTN; PAM sequence: CTG
taattggacttcaggcacca

SEQ ID NO: 14363 - DNA, 20 bp, Artificial Sequence
  Description of Artificial Sequence: Synthetic oligonucleotide
  Target: SOD1; (-) strand; PAM type: YTN; PAM sequence: CTG
gtcctgtaattggacttcag

SEQ ID NO: 14364 - DNA, 20 bp, Artificial Sequence
  Description of Artificial Sequence: Synthetic oligonucleotide
  Target: SOD1; (-) strand; PAM type: YTN; PAM sequence: TTG
cccctggtcctgtaattgga

SEQ ID NO: 14365 - DNA, 20 bp, Artificial Sequence
  Description of Artificial Sequence: Synthetic oligonucleotide
  Target: SOD1; (-) strand; PAM type: YTN; PAM sequence: CTC
aaggagttgcccctggtcct

SEQ ID NO: 14366 - DNA, 20 bp, Artificial Sequence
  Description of Artificial Sequence: Synthetic oligonucleotide
  Target: SOD1; (-) strand; PAM type: YTN; PAM sequence: TTA
ggcactcaaggagttgcccc

SEQ ID NO: 14367 - DNA, 20 bp, Artificial Sequence
  Description of Artificial Sequence: Synthetic oligonucleotide
  Target: SOD1; (-) strand; PAM type: YTN; PAM sequence: TTT
aggcactcaaggagttgccc

SEQ ID NO: 14368 - DNA, 20 bp, Artificial Sequence
  Description of Artificial Sequence: Synthetic oligonucleotide
  Target: SOD1; (-) strand; PAM type: YTN; PAM sequence: TTT
taggcactcaaggagttgcc

SEQ ID NO: 14369 - DNA, 20 bp, Artificial Sequence
  Description of Artificial Sequence: Synthetic oligonucleotide
  Target: SOD1; (-) strand; PAM type: YTN; PAM sequence: CTT
ttaggcactcaaggagttgc

SEQ ID NO: 14370 - DNA, 20 bp, Artificial Sequence
  Description of Artificial Sequence: Synthetic oligonucleotide
  Target: SOD1; (-) strand; PAM type: YTN; PAM sequence: TTG
tcgtcttttaggcactcaag

SEQ ID NO: 14371 - DNA, 20 bp, Artificial Sequence
  Description of Artificial Sequence: Synthetic oligonucleotide
  Target: SOD1; (-) strand; PAM type: YTN; PAM sequence: TTT
gtcgtcttttaggcactcaa

SEQ ID NO: 14372 - DNA, 20 bp, Artificial Sequence
  Description of Artificial Sequence: Synthetic oligonucleotide
  Target: SOD1; (-) strand; PAM type: YTN; PAM sequence: TTT
tgtcgtcttttaggcactca

SEQ ID NO: 14373 - DNA, 20 bp, Artificial Sequence
  Description of Artificial Sequence: Synthetic oligonucleotide
  Target: SOD1; (-) strand; PAM type: YTN; PAM sequence: TTT
ttgtcgtcttttaggcactc

SEQ ID NO: 14374 - DNA, 20 bp, Artificial Sequence
  Description of Artificial Sequence: Synthetic oligonucleotide
  Target: SOD1; (-) strand; PAM type: YTN; PAM sequence: TTA
tttttgtcgtcttttaggca

SEQ ID NO: 14375 - DNA, 20 bp, Artificial Sequence
  Description of Artificial Sequence: Synthetic oligonucleotide
  Target: SOD1; (-) strand; PAM type: YTN; PAM sequence: TTT
atttttgtcgtcttttaggc

SEQ ID NO: 14376 - DNA, 20 bp, Artificial Sequence
  Description of Artificial Sequence: Synthetic oligonucleotide
  Target: SOD1; (-) strand; PAM type: YTN; PAM sequence: TTT
tatttttgtcgtcttttagg

SEQ ID NO: 14377 - DNA, 20 bp, Artificial Sequence
  Description of Artificial Sequence: Synthetic oligonucleotide
  Target: SOD1; (-) strand; PAM type: YTN; PAM sequence: TTT
ttatttttgtcgtcttttag

SEQ ID NO: 14378 - DNA, 20 bp, Artificial Sequence
  Description of Artificial Sequence: Synthetic oligonucleotide
  Target: SOD1; (-) strand; PAM type: YTN; PAM sequence: TTA
catttttatttttgtcgtct

SEQ ID NO: 14379 - DNA, 20 bp, Artificial Sequence
  Description of Artificial Sequence: Synthetic oligonucleotide
  Target: SOD1; (-) strand; PAM type: YTN; PAM sequence: TTT
acatttttatttttgtcgtc

SEQ ID NO: 14380 - DNA, 20 bp, Artificial Sequence
  Description of Artificial Sequence: Synthetic oligonucleotide
  Target: SOD1; (-) strand; PAM type: YTN; PAM sequence: TTC
ggtggtgtttacatttttat

SEQ ID NO: 14381 - DNA, 20 bp, Artificial Sequence
  Description of Artificial Sequence: Synthetic oligonucleotide
  Target: SOD1; (-) strand; PAM type: YTN; PAM sequence: CTT
cggtggtgtttacattttta

SEQ ID NO: 14382 - DNA, 20 bp, Artificial Sequence
  Description of Artificial Sequence: Synthetic oligonucleotide
  Target: SOD1; (-) strand; PAM type: YTN; PAM sequence: CTG
gagtgccatcttcggtggtg

SEQ ID NO: 14383 - DNA, 20 bp, Artificial Sequence
  Description of Artificial Sequence: Synthetic oligonucleotide
  Target: SOD1; (-) strand; PAM type: YTN; PAM sequence: CTG
aaactggagtgccatcttcg

SEQ ID NO: 14384 - DNA, 20 bp, Artificial Sequence
  Description of Artificial Sequence: Synthetic oligonucleotide
  Target: SOD1; (-) strand; PAM type: YTN; PAM sequence: TTA
agcgccacagaacacagctg

SEQ ID NO: 14385 - DNA, 20 bp, Artificial Sequence
  Description of Artificial Sequence: Synthetic oligonucleotide
  Target: SOD1; (-) strand; PAM type: YTN; PAM sequence: TTT
aagcgccacagaacacagct

SEQ ID NO: 14386 - DNA, 20 bp, Artificial Sequence
  Description of Artificial Sequence: Synthetic oligonucleotide
  Target: SOD1; (-) strand; PAM type: YTN; PAM sequence: CTT
taagcgccacagaacacagc

SEQ ID NO: 14387 - DNA, 20 bp, Artificial Sequence
  Description of Artificial Sequence: Synthetic oligonucleotide
  Target: SOD1; (-) strand; PAM type: YTN; PAM sequence: TTG
ctttaagcgccacagaacac

SEQ ID NO: 14388 - DNA, 20 bp, Artificial Sequence
  Description of Artificial Sequence: Synthetic oligonucleotide
  Target: SOD1; (-) strand; PAM type: YTN; PAM sequence: TTT
gctttaagcgccacagaaca

SEQ ID NO: 14389 - DNA, 20 bp, Artificial Sequence
  Description of Artificial Sequence: Synthetic oligonucleotide
  Target: SOD1; (-) strand; PAM type: YTN; PAM sequence: TTT
tgctttaagcgccacagaac

SEQ ID NO: 14390 - DNA, 20 bp, Artificial Sequence
  Description of Artificial Sequence: Synthetic oligonucleotide
  Target: SOD1; (-) strand; PAM type: YTN; PAM sequence: TTA
ttttgctttaagcgccacag

SEQ ID NO: 14391 - DNA, 20 bp, Artificial Sequence
  Description of Artificial Sequence: Synthetic oligonucleotide
  Target: SOD1; (-) strand; PAM type: YTN; PAM sequence: TTT
attttgctttaagcgccaca

SEQ ID NO: 14392 - DNA, 20 bp, Artificial Sequence
  Description of Artificial Sequence: Synthetic oligonucleotide
  Target: SOD1; (-) strand; PAM type: YTN; PAM sequence: TTT
tattttgctttaagcgccac

SEQ ID NO: 14393 - DNA, 20 bp, Artificial Sequence
  Description of Artificial Sequence: Synthetic oligonucleotide
  Target: SOD1; (-) strand; PAM type: YTN; PAM sequence: TTG
aattttattttgctttaagc

SEQ ID NO: 14394 - DNA, 20 bp, Artificial Sequence
  Description of Artificial Sequence: Synthetic oligonucleotide
  Target: SOD1; (-) strand; PAM type: YTN; PAM sequence: TTG
tgggttgaattttattttgc

SEQ ID NO: 14395 - DNA, 20 bp, Artificial Sequence
  Description of Artificial Sequence: Synthetic oligonucleotide
  Target: SOD1; (-) strand; PAM type: YTN; PAM sequence: TTG
aagattgtgggttgaatttt

SEQ ID NO: 14396 - DNA, 20 bp, Artificial Sequence
  Description of Artificial Sequence: Synthetic oligonucleotide
  Target: SOD1; (-) strand; PAM type: YTN; PAM sequence: TTT
gaagattgtgggttgaattt

SEQ ID NO: 14397 - DNA, 20 bp, Artificial Sequence
  Description of Artificial Sequence: Synthetic oligonucleotide
  Target: SOD1; (-) strand; PAM type: YTN; PAM sequence: CTA
tgaaatttgaagattgtggg

SEQ ID NO: 14398 - DNA, 20 bp, Artificial Sequence
  Description of Artificial Sequence: Synthetic oligonucleotide
  Target: SOD1; (-) strand; PAM type: YTN; PAM sequence: TTG
tgacagagtggcaaactatg

SEQ ID NO: 14399 - DNA, 20 bp, Artificial Sequence
  Description of Artificial Sequence: Synthetic oligonucleotide
  Target: SOD1; (-) strand; PAM type: YTN; PAM sequence: TTT
gtgacagagtggcaaactat

SEQ ID NO: 14400 - DNA, 20 bp, Artificial Sequence
  Description of Artificial Sequence: Synthetic oligonucleotide
  Target: SOD1; (-) strand; PAM type: YTN; PAM sequence: CTG
ggtttgtgacagagtggcaa

SEQ ID NO: 14401 - DNA, 20 bp, Artificial Sequence
  Description of Artificial Sequence: Synthetic oligonucleotide
  Target: SOD1; (-) strand; PAM type: YTN; PAM sequence: CTC
acactgggtttgtgacagag

SEQ ID NO: 14402 - DNA, 20 bp, Artificial Sequence
  Description of Artificial Sequence: Synthetic oligonucleotide
  Target: SOD1; (-) strand; PAM type: YTN; PAM sequence: CTA
ggcctcacactgggtttgtg

SEQ ID NO: 14403 - DNA, 20 bp, Artificial Sequence
  Description of Artificial Sequence: Synthetic oligonucleotide
  Target: SOD1; (-) strand; PAM type: YTN; PAM sequence: TTA
ctaggcctcacactgggttt

SEQ ID NO: 14404 - DNA, 20 bp, Artificial Sequence
  Description of Artificial Sequence: Synthetic oligonucleotide
  Target: SOD1; (-) strand; PAM type: YTN; PAM sequence: TTG
ttactaggcctcacactggg

SEQ ID NO: 14405 - DNA, 20 bp, Artificial Sequence
  Description of Artificial Sequence: Synthetic oligonucleotide
  Target: SOD1; (-) strand; PAM type: YTN; PAM sequence: TTA
ggttgttactaggcctcaca

SEQ ID NO: 14406 - DNA, 20 bp, Artificial Sequence
  Description of Artificial Sequence: Synthetic oligonucleotide
  Target: SOD1; (-) strand; PAM type: YTN; PAM sequence: CTT
aggttgttactaggcctcac

SEQ ID NO: 14407 - DNA, 20 bp, Artificial Sequence
  Description of Artificial Sequence: Synthetic oligonucleotide
  Target: SOD1; (-) strand; PAM type: YTN; PAM sequence: TTG
ccttaggttgttactaggcc

SEQ ID NO: 14408 - DNA, 20 bp, Artificial Sequence
  Description of Artificial Sequence: Synthetic oligonucleotide
  Target: SOD1; (-) strand; PAM type: YTN; PAM sequence: CTT
gccttaggttgttactaggc

SEQ ID NO: 14409 - DNA, 20 bp, Artificial Sequence
  Description of Artificial Sequence: Synthetic oligonucleotide
  Target: SOD1; (-) strand; PAM type: YTN; PAM sequence: TTG
cttgccttaggttgttacta

SEQ ID NO: 14410 - DNA, 20 bp, Artificial Sequence
  Description of Artificial Sequence: Synthetic oligonucleotide
  Target: SOD1; (-) strand; PAM type: YTN; PAM sequence: TTG
caattgcttgccttaggttg

SEQ ID NO: 14411 - DNA, 20 bp, Artificial Sequence
  Description of Artificial Sequence: Synthetic oligonucleotide
  Target: SOD1; (-) strand; PAM type: YTN; PAM sequence: TTT
gcaattgcttgccttaggtt

SEQ ID NO: 14412 - DNA, 20 bp, Artificial Sequence
  Description of Artificial Sequence: Synthetic oligonucleotide
  Target: SOD1; (-) strand; PAM type: YTN; PAM sequence: CTT
tgcaattgcttgccttaggt

SEQ ID NO: 14413 - DNA, 20 bp, Artificial Sequence
  Description of Artificial Sequence: Synthetic oligonucleotide
  Target: SOD1; (-) strand; PAM type: YTN; PAM sequence: TTA
aaaatgtctttgcaattgct

SEQ ID NO: 14414 - DNA, 20 bp, Artificial Sequence
  Description of Artificial Sequence: Synthetic oligonucleotide
  Target: SOD1; (-) strand; PAM type: YTN; PAM sequence: TTT
aaaaatgtctttgcaattgc

SEQ ID NO: 14415 - DNA, 20 bp, Artificial Sequence
  Description of Artificial Sequence: Synthetic oligonucleotide
  Target: SOD1; (-) strand; PAM type: YTN; PAM sequence: CTT
taaaaatgtctttgcaattg

SEQ ID NO: 14416 - DNA, 20 bp, Artificial Sequence
  Description of Artificial Sequence: Synthetic oligonucleotide
  Target: SOD1; (-) strand; PAM type: YTN; PAM sequence: TTA
gatactttaaaaatgtcttt

SEQ ID NO: 14417 - DNA, 20 bp, Artificial Sequence
  Description of Artificial Sequence: Synthetic oligonucleotide
  Target: SOD1; (-) strand; PAM type: YTN; PAM sequence: CTG
tattagatactttaaaaatg

SEQ ID NO: 14418 - DNA, 20 bp, Artificial Sequence
  Description of Artificial Sequence: Synthetic oligonucleotide
  Target: SOD1; (-) strand; PAM type: YTN; PAM sequence: CTA
cctgtattagatactttaaa

SEQ ID NO: 14419 - DNA, 20 bp, Artificial Sequence
  Description of Artificial Sequence: Synthetic oligonucleotide
  Target: SOD1; (-) strand; PAM type: YTN; PAM sequence: CTC
tacctgtattagatacttta

SEQ ID NO: 14420 - DNA, 20 bp, Artificial Sequence
  Description of Artificial Sequence: Synthetic oligonucleotide
  Target: SOD1; (-) strand; PAM type: YTN; PAM sequence: CTG
gcctctacctgtattagata

SEQ ID NO: 14421 - DNA, 20 bp, Artificial Sequence
  Description of Artificial Sequence: Synthetic oligonucleotide
  Target: SOD1; (-) strand; PAM type: YTN; PAM sequence: TTC
tggcctctacctgtattaga

SEQ ID NO: 14422 - DNA, 20 bp, Artificial Sequence
  Description of Artificial Sequence: Synthetic oligonucleotide
  Target: SOD1; (-) strand; PAM type: YTN; PAM sequence: TTA
ttctggcctctacctgtatt

SEQ ID NO: 14423 - DNA, 20 bp, Artificial Sequence
  Description of Artificial Sequence: Synthetic oligonucleotide
  Target: SOD1; (-) strand; PAM type: YTN; PAM sequence: TTT
attctggcctctacctgtat

SEQ ID NO: 14424 - DNA, 20 bp, Artificial Sequence
  Description of Artificial Sequence: Synthetic oligonucleotide
  Target: SOD1; (-) strand; PAM type: YTN; PAM sequence: TTC
ccagtttattctggcctcta

SEQ ID NO: 14425 - DNA, 20 bp, Artificial Sequence
  Description of Artificial Sequence: Synthetic oligonucleotide
  Target: SOD1; (-) strand; PAM type: YTN; PAM sequence: TTT
cccagtttattctggcctct

SEQ ID NO: 14426 - DNA, 20 bp, Artificial Sequence
  Description of Artificial Sequence: Synthetic oligonucleotide
  Target: SOD1; (-) strand; PAM type: YTN; PAM sequence: TTA
tttcccagtttattctggcc

SEQ ID NO: 14427 - DNA, 20 bp, Artificial Sequence
  Description of Artificial Sequence: Synthetic oligonucleotide
  Target: SOD1; (-) strand; PAM type: YTN; PAM sequence: TTT
atttcccagtttattctggc

SEQ ID NO: 14428 - DNA, 20 bp, Artificial Sequence
  Description of Artificial Sequence: Synthetic oligonucleotide
  Target: SOD1; (-) strand; PAM type: YTN; PAM sequence: TTT
tatttcccagtttattctgg

SEQ ID NO: 14429 - DNA, 20 bp, Artificial Sequence
  Description of Artificial Sequence: Synthetic oligonucleotide
  Target: SOD1; (-) strand; PAM type: YTN; PAM sequence: CTA
ttttatttcccagtttattc

SEQ ID NO: 14430 - DNA, 20 bp, Artificial Sequence
  Description of Artificial Sequence: Synthetic oligonucleotide
  Target: SOD1; (-) strand; PAM type: YTN; PAM sequence: TTA
ctattttatttcccagttta

SEQ ID NO: 14431 - DNA, 20 bp, Artificial Sequence
  Description of Artificial Sequence: Synthetic oligonucleotide
  Target: SOD1; (-) strand; PAM type: YTN; PAM sequence: TTA
ccattactattttatttccc

SEQ ID NO: 14432 - DNA, 20 bp, Artificial Sequence
  Description of Artificial Sequence: Synthetic oligonucleotide
  Target: SOD1; (-) strand; PAM type: YTN; PAM sequence: TTG
gtattaccattactatttta

SEQ ID NO: 14433 - DNA, 20 bp, Artificial Sequence
  Description of Artificial Sequence: Synthetic oligonucleotide
  Target: SOD1; (-) strand; PAM type: YTN; PAM sequence: TTG
aaaattggtattaccattac

SEQ ID NO: 14434 - DNA, 20 bp, Artificial Sequence
  Description of Artificial Sequence: Synthetic oligonucleotide
  Target: SOD1; (-) strand; PAM type: YTN; PAM sequence: TTT
gaaaattggtattaccatta

SEQ ID NO: 14435 - DNA, 20 bp, Artificial Sequence
  Description of Artificial Sequence: Synthetic oligonucleotide
  Target: SOD1; (-) strand; PAM type: YTN; PAM sequence: CTT
tgaaaattggtattaccatt

SEQ ID NO: 14436 - DNA, 20 bp, Artificial Sequence
  Description of Artificial Sequence: Synthetic oligonucleotide
  Target: SOD1; (-) strand; PAM type: YTN; PAM sequence: CTC
tttgaaaattggtattacca

SEQ ID NO: 14437 - DNA, 20 bp, Artificial Sequence
  Description of Artificial Sequence: Synthetic oligonucleotide
  Target: SOD1; (-) strand; PAM type: YTN; PAM sequence: TTG
acatactctttgaaaattgg

SEQ ID NO: 14438 - DNA, 20 bp, Artificial Sequence
  Description of Artificial Sequence: Synthetic oligonucleotide
  Target: SOD1; (-) strand; PAM type: YTN; PAM sequence: TTT
gacatactctttgaaaattg

SEQ ID NO: 14439 - DNA, 20 bp, Artificial Sequence
  Description of Artificial Sequence: Synthetic oligonucleotide
  Target: SOD1; (-) strand; PAM type: YTN; PAM sequence: TTT
tgacatactctttgaaaatt

SEQ ID NO: 14440 - DNA, 20 bp, Artificial Sequence
  Description of Artificial Sequence: Synthetic oligonucleotide
  Target: SOD1; (-) strand; PAM type: YTN; PAM sequence: CTA
caggagattttgacatactc

SEQ ID NO: 14441 - DNA, 20 bp, Artificial Sequence
  Description of Artificial Sequence: Synthetic oligonucleotide
  Target: SOD1; (-) strand; PAM type: YTN; PAM sequence: CTA
atgaaagctacaggagattt

SEQ ID NO: 14442 - DNA, 20 bp, Artificial Sequence
  Description of Artificial Sequence: Synthetic oligonucleotide
  Target: SOD1; (-) strand; PAM type: YTN; PAM sequence: TTC
taatgaaagctacaggagat

SEQ ID NO: 14443 - DNA, 20 bp, Artificial Sequence
  Description of Artificial Sequence: Synthetic oligonucleotide
  Target: SOD1; (-) strand; PAM type: YTN; PAM sequence: CTT
ctaatgaaagctacaggaga

SEQ ID NO: 14444 - DNA, 20 bp, Artificial Sequence
  Description of Artificial Sequence: Synthetic oligonucleotide
  Target: SOD1; (-) strand; PAM type: YTN; PAM sequence: TTG
gagtgggaagacagcttcta

SEQ ID NO: 14445 - DNA, 20 bp, Artificial Sequence
  Description of Artificial Sequence: Synthetic oligonucleotide
  Target: SOD1; (-) strand; PAM type: YTN; PAM sequence: TTT
ggagtgggaagacagcttct

SEQ ID NO: 14446 - DNA, 20 bp, Artificial Sequence
  Description of Artificial Sequence: Synthetic oligonucleotide
  Target: SOD1; (-) strand; PAM type: YTN; PAM sequence: CTC
aaatgtatttggagtgggaa

SEQ ID NO: 14447 - DNA, 20 bp, Artificial Sequence
  Description of Artificial Sequence: Synthetic oligonucleotide
  Target: SOD1; (-) strand; PAM type: YTN; PAM sequence: TTC
tcaaatgtatttggagtggg

SEQ ID NO: 14448 - DNA, 20 bp, Artificial Sequence
  Description of Artificial Sequence: Synthetic oligonucleotide
  Target: SOD1; (-) strand; PAM type: YTN; PAM sequence: TTT
ctcaaatgtatttggagtgg

SEQ ID NO: 14449 - DNA, 20 bp, Artificial Sequence
  Description of Artificial Sequence: Synthetic oligonucleotide
  Target: SOD1; (-) strand; PAM type: YTN; PAM sequence: CTG
tgtttctcaaatgtatttgg

SEQ ID NO: 14450 - DNA, 20 bp, Artificial Sequence
  Description of Artificial Sequence: Synthetic oligonucleotide
  Target: SOD1; (-) strand; PAM type: YTN; PAM sequence: TTA
gcacactgtgtttctcaaat

SEQ ID NO: 14451 - DNA, 20 bp, Artificial Sequence
  Description of Artificial Sequence: Synthetic oligonucleotide
  Target: SOD1; (-) strand; PAM type: YTN; PAM sequence: CTT
agcacactgtgtttctcaaa

SEQ ID NO: 14452 - DNA, 20 bp, Artificial Sequence
  Description of Artificial Sequence: Synthetic oligonucleotide
  Target: SOD1; (-) strand; PAM type: YTN; PAM sequence: TTA
ggacttagcacactgtgttt

SEQ ID NO: 14453 - DNA, 20 bp, Artificial Sequence
  Description of Artificial Sequence: Synthetic oligonucleotide
  Target: SOD1; (-) strand; PAM type: YTN; PAM sequence: CTC
attaggacttagcacactgt

SEQ ID NO: 14454 - DNA, 20 bp, Artificial Sequence
  Description of Artificial Sequence: Synthetic oligonucleotide
  Target: SOD1; (-) strand; PAM type: YTN; PAM sequence: TTA
tctcattaggacttagcaca

SEQ ID NO: 14455 - DNA, 20 bp, Artificial Sequence
  Description of Artificial Sequence: Synthetic oligonucleotide
  Target: SOD1; (-) strand; PAM type: YTN; PAM sequence: TTT
atctcattaggacttagcac

SEQ ID NO: 14456 - DNA, 20 bp, Artificial Sequence
  Description of Artificial Sequence: Synthetic oligonucleotide
  Target: SOD1; (-) strand; PAM type: YTN; PAM sequence: CTG
atagtgaatgtatttatctc

SEQ ID NO: 14457 - DNA, 20 bp, Artificial Sequence
  Description of Artificial Sequence: Synthetic oligonucleotide
  Target: SOD1; (-) strand; PAM type: YTN; PAM sequence: TTA
ctgatagtgaatgtatttat

SEQ ID NO: 14458 - DNA, 20 bp, Artificial Sequence
  Description of Artificial Sequence: Synthetic oligonucleotide
  Target: SOD1; (-) strand; PAM type: YTN; PAM sequence: TTG
aatagttactgatagtgaat

SEQ ID NO: 14459 - DNA, 20 bp, Artificial Sequence
  Description of Artificial Sequence: Synthetic oligonucleotide
  Target: SOD1; (-) strand; PAM type: YTN; PAM sequence: CTT
gaatagttactgatagtgaa

SEQ ID NO: 14460 - DNA, 20 bp, Artificial Sequence
  Description of Artificial Sequence: Synthetic oligonucleotide
  Target: SOD1; (-) strand; PAM type: YTN; PAM sequence: TTA
gcttgaatagttactgatag

SEQ ID NO: 14461 - DNA, 20 bp, Artificial Sequence
  Description of Artificial Sequence: Synthetic oligonucleotide
  Target: SOD1; (-) strand; PAM type: YTN; PAM sequence: TTA
gttagcttgaatagttactg

SEQ ID NO: 14462 - DNA, 20 bp, Artificial Sequence
  Description of Artificial Sequence: Synthetic oligonucleotide
  Target: SOD1; (-) strand; PAM type: YTN; PAM sequence: CTT
agttagcttgaatagttact

SEQ ID NO: 14463 - DNA, 20 bp, Artificial Sequence
  Description of Artificial Sequence: Synthetic oligonucleotide
  Target: SOD1; (-) strand; PAM type: YTN; PAM sequence: CTG
cagtatgcttagttagcttg

SEQ ID NO: 14464 - DNA, 20 bp, Artificial Sequence
  Description of Artificial Sequence: Synthetic oligonucleotide
  Target: SOD1; (-) strand; PAM type: YTN; PAM sequence: CTA
agtgtgcacctgcagtatgc

SEQ ID NO: 14465 - DNA, 20 bp, Artificial Sequence
  Description of Artificial Sequence: Synthetic oligonucleotide
  Target: SOD1; (-) strand; PAM type: YTN; PAM sequence: TTC
taagtgtgcacctgcagtat

SEQ ID NO: 14466 - DNA, 20 bp, Artificial Sequence
  Description of Artificial Sequence: Synthetic oligonucleotide
  Target: SOD1; (-) strand; PAM type: YTN; PAM sequence: TTT
ctaagtgtgcacctgcagta

SEQ ID NO: 14467 - DNA, 20 bp, Artificial Sequence
  Description of Artificial Sequence: Synthetic oligonucleotide
  Target: SOD1; (-) strand; PAM type: YTN; PAM sequence: TTT
tctaagtgtgcacctgcagt

SEQ ID NO: 14468 - DNA, 20 bp, Artificial Sequence
  Description of Artificial Sequence: Synthetic oligonucleotide
  Target: SOD1; (-) strand; PAM type: YTN; PAM sequence: CTA
gtaataagacggggtgtaaa

SEQ ID NO: 14469 - DNA, 20 bp, Artificial Sequence
  Description of Artificial Sequence: Synthetic oligonucleotide
  Target: SOD1; (-) strand; PAM type: YTN; PAM sequence: TTC
tagtaataagacggggtgta

SEQ ID NO: 14470 - DNA, 20 bp, Artificial Sequence
  Description of Artificial Sequence: Synthetic oligonucleotide
  Target: SOD1; (-) strand; PAM type: YTN; PAM sequence: TTT
ctagtaataagacggggtgt

SEQ ID NO: 14471 - DNA, 20 bp, Artificial Sequence
  Description of Artificial Sequence: Synthetic oligonucleotide
  Target: SOD1; (-) strand; PAM type: YTN; PAM sequence: TTT
tctagtaataagacggggtg

SEQ ID NO: 14472 - DNA, 20 bp, Artificial Sequence
  Description of Artificial Sequence: Synthetic oligonucleotide
  Target: SOD1; (-) strand; PAM type: YTN; PAM sequence: TTT
ttctagtaataagacggggt

SEQ ID NO: 14473 - DNA, 20 bp, Artificial Sequence
  Description of Artificial Sequence: Synthetic oligonucleotide
  Target: SOD1; (-) strand; PAM type: YTN; PAM sequence: TTT
tttctagtaataagacgggg

SEQ ID NO: 14474 - DNA, 20 bp, Artificial Sequence
  Description of Artificial Sequence: Synthetic oligonucleotide
  Target: SOD1; (-) strand; PAM type: YTN; PAM sequence: TTT
ttttctagtaataagacggg

SEQ ID NO: 14475 - DNA, 20 bp, Artificial Sequence
  Description of Artificial Sequence: Synthetic oligonucleotide
  Target: SOD1; (-) strand; PAM type: YTN; PAM sequence: CTC
atttttttctagtaataaga

SEQ ID NO: 14476 - DNA, 20 bp, Artificial Sequence
  Description of Artificial Sequence: Synthetic oligonucleotide
  Target: SOD1; (-) strand; PAM type: YTN; PAM sequence: CTA
ggtcagtgacctcatttttt

SEQ ID NO: 14477 - DNA, 20 bp, Artificial Sequence
  Description of Artificial Sequence: Synthetic oligonucleotide
  Target: SOD1; (-) strand; PAM type: YTN; PAM sequence: TTC
taggtcagtgacctcatttt

SEQ ID NO: 14478 - DNA, 20 bp, Artificial Sequence
  Description of Artificial Sequence: Synthetic oligonucleotide
  Target: SOD1; (-) strand; PAM type: YTN; PAM sequence: TTT
ctaggtcagtgacctcattt

SEQ ID NO: 14479 - DNA, 20 bp, Artificial Sequence
  Description of Artificial Sequence: Synthetic oligonucleotide
  Target: SOD1; (-) strand; PAM type: YTN; PAM sequence: TTT
tctaggtcagtgacctcatt

SEQ ID NO: 14480 - DNA, 20 bp, Artificial Sequence
  Description of Artificial Sequence: Synthetic oligonucleotide
  Target: SOD1; (-) strand; PAM type: YTN; PAM sequence: CTG
ggttttctaggtcagtgacc

SEQ ID NO: 14481 - DNA, 20 bp, Artificial Sequence
  Description of Artificial Sequence: Synthetic oligonucleotide
  Target: SOD1; (-) strand; PAM type: YTN; PAM sequence: TTC
ctgggttttctaggtcagtg

SEQ ID NO: 14482 - DNA, 20 bp, Artificial Sequence
  Description of Artificial Sequence: Synthetic oligonucleotide
  Target: SOD1; (-) strand; PAM type: YTN; PAM sequence: TTT
cctgggttttctaggtcagt

SEQ ID NO: 14483 - DNA, 20 bp, Artificial Sequence
  Description of Artificial Sequence: Synthetic oligonucleotide
  Target: SOD1; (-) strand; PAM type: YTN; PAM sequence: CTT
tcctgggttttctaggtcag

SEQ ID NO: 14484 - DNA, 20 bp, Artificial Sequence
  Description of Artificial Sequence: Synthetic oligonucleotide
  Target: SOD1; (-) strand; PAM type: YTN; PAM sequence: CTC
tttcctgggttttctaggtc

SEQ ID NO: 14485 - DNA, 20 bp, Artificial Sequence
  Description of Artificial Sequence: Synthetic oligonucleotide
  Target: SOD1; (-) strand; PAM type: YTN; PAM sequence: TTC
ctctttcctgggttttctag

SEQ ID NO: 14486 - DNA, 20 bp, Artificial Sequence
  Description of Artificial Sequence: Synthetic oligonucleotide
  Target: SOD1; (-) strand; PAM type: YTN; PAM sequence: CTT
cctctttcctgggttttcta

SEQ ID NO: 14487 - DNA, 20 bp, Artificial Sequence
  Description of Artificial Sequence: Synthetic oligonucleotide
  Target: SOD1; (-) strand; PAM type: YTN; PAM sequence: CTA
agtgtagcatggagtcaaag

SEQ ID NO: 14488 - DNA, 20 bp, Artificial Sequence
  Description of Artificial Sequence: Synthetic oligonucleotide
  Target: SOD1; (-) strand; PAM type: YTN; PAM sequence: TTA
ataatatggactaagtgtag

SEQ ID NO: 14489 - DNA, 20 bp, Artificial Sequence
  Description of Artificial Sequence: Synthetic oligonucleotide
  Target: SOD1; (-) strand; PAM type: YTN; PAM sequence: TTT
aataatatggactaagtgta

SEQ ID NO: 14490 - DNA, 20 bp, Artificial Sequence
  Description of Artificial Sequence: Synthetic oligonucleotide
  Target: SOD1; (-) strand; PAM type: YTN; PAM sequence: TTT
taataatatggactaagtgt

SEQ ID NO: 14491 - DNA, 20 bp, Artificial Sequence
  Description of Artificial Sequence: Synthetic oligonucleotide
  Target: SOD1; (-) strand; PAM type: YTN; PAM sequence: CTG
catgaggcattttaataata

SEQ ID NO: 14492 - DNA, 20 bp, Artificial Sequence
  Description of Artificial Sequence: Synthetic oligonucleotide
  Target: SOD1; (-) strand; PAM type: YTN; PAM sequence: TTG
catagtaactgcatgaggca

SEQ ID NO: 14493 - DNA, 20 bp, Artificial Sequence
  Description of Artificial Sequence: Synthetic oligonucleotide
  Target: SOD1; (-) strand; PAM type: YTN; PAM sequence: TTG
atgcacattgcatagtaact

SEQ ID NO: 14494 - DNA, 20 bp, Artificial Sequence
  Description of Artificial Sequence: Synthetic oligonucleotide
  Target: SOD1; (-) strand; PAM type: YTN; PAM sequence: TTT
gatgcacattgcatagtaac

SEQ ID NO: 14495 - DNA, 20 bp, Artificial Sequence
  Description of Artificial Sequence: Synthetic oligonucleotide
  Target: SOD1; (-) strand; PAM type: YTN; PAM sequence: TTA
tttgatgcacattgcatagt

SEQ ID NO: 14496 - DNA, 20 bp, Artificial Sequence
  Description of Artificial Sequence: Synthetic oligonucleotide
  Target: SOD1; (-) strand; PAM type: YTN; PAM sequence: TTT
atttgatgcacattgcatag

SEQ ID NO: 14497 - DNA, 20 bp, Artificial Sequence
  Description of Artificial Sequence: Synthetic oligonucleotide
  Target: SOD1; (-) strand; PAM type: YTN; PAM sequence: TTA
gtgtttatttgatgcacatt

SEQ ID NO: 14498 - DNA, 20 bp, Artificial Sequence
  Description of Artificial Sequence: Synthetic oligonucleotide
  Target: SOD1; (-) strand; PAM type: YTN; PAM sequence: TTG
tagacattagtgtttatttg

SEQ ID NO: 14499 - DNA, 20 bp, Artificial Sequence
  Description of Artificial Sequence: Synthetic oligonucleotide
  Target: SOD1; (-) strand; PAM type: YTN; PAM sequence: TTT
gtagacattagtgtttattt

SEQ ID NO: 14500 - DNA, 20 bp, Artificial Sequence
  Description of Artificial Sequence: Synthetic oligonucleotide
  Target: SOD1; (-) strand; PAM type: YTN; PAM sequence: TTT
tgtagacattagtgtttatt

SEQ ID NO: 14501 - DNA, 20 bp, Artificial Sequence
  Description of Artificial Sequence: Synthetic oligonucleotide
  Target: SOD1; (-) strand; PAM type: YTN; PAM sequence: TTG
ttttgtagacattagtgttt

SEQ ID NO: 14502 - DNA, 20 bp, Artificial Sequence
  Description of Artificial Sequence: Synthetic oligonucleotide
  Target: SOD1; (-) strand; PAM type: YTN; PAM sequence: TTT
gttttgtagacattagtgtt

SEQ ID NO: 14503 - DNA, 20 bp, Artificial Sequence
  Description of Artificial Sequence: Synthetic oligonucleotide
  Target: SOD1; (-) strand; PAM type: YTN; PAM sequence: CTT
tgttttgtagacattagtgt

SEQ ID NO: 14504 - DNA, 20 bp, Artificial Sequence
  Description of Artificial Sequence: Synthetic oligonucleotide
  Target: SOD1; (-) strand; PAM type: YTN; PAM sequence: TTG
tgtatggatctttgttttgt

SEQ ID NO: 14505 - DNA, 20 bp, Artificial Sequence
  Description of Artificial Sequence: Synthetic oligonucleotide
  Target: SOD1; (-) strand; PAM type: YTN; PAM sequence: TTT
gtgtatggatctttgttttg

SEQ ID NO: 14506 - DNA, 20 bp, Artificial Sequence
  Description of Artificial Sequence: Synthetic oligonucleotide
  Target: SOD1; (-) strand; PAM type: YTN; PAM sequence: TTC
acatttgtgtatggatcttt

SEQ ID NO: 14507 - DNA, 20 bp, Artificial Sequence
  Description of Artificial Sequence: Synthetic oligonucleotide
  Target: SOD1; (-) strand; PAM type: YTN; PAM sequence: CTT
cacatttgtgtatggatctt

SEQ ID NO: 14508 - DNA, 20 bp, Artificial Sequence
  Description of Artificial Sequence: Synthetic oligonucleotide
  Target: SOD1; (-) strand; PAM type: YTN; PAM sequence: CTG
taacagtaaacttcacattt

SEQ ID NO: 14509 - DNA, 20 bp, Artificial Sequence
  Description of Artificial Sequence: Synthetic oligonucleotide
  Target: SOD1; (-) strand; PAM type: YTN; PAM sequence: TTG
aaaaaggaactgtaacagta

SEQ ID NO: 14510 - DNA, 20 bp, Artificial Sequence
  Description of Artificial Sequence: Synthetic oligonucleotide
  Target: SOD1; (-) strand; PAM type: YTN; PAM sequence: CTT
gaaaaaggaactgtaacagt

SEQ ID NO: 14511 - DNA, 20 bp, Artificial Sequence
  Description of Artificial Sequence: Synthetic oligonucleotide
  Target: SOD1; (-) strand; PAM type: YTN; PAM sequence: CTG
tgccttgaaaaaggaactgt

SEQ ID NO: 14512 - DNA, 20 bp, Artificial Sequence
  Description of Artificial Sequence: Synthetic oligonucleotide
  Target: SOD1; (-) strand; PAM type: YTN; PAM sequence: TTA
aatatcatgctgtgccttga

SEQ ID NO: 14513 - DNA, 20 bp, Artificial Sequence
  Description of Artificial Sequence: Synthetic oligonucleotide
  Target: SOD1; (-) strand; PAM type: YTN; PAM sequence: CTC
gcaagttaaatatcatgctg

SEQ ID NO: 14514 - DNA, 20 bp, Artificial Sequence
  Description of Artificial Sequence: Synthetic oligonucleotide
  Target: SOD1; (-) strand; PAM type: YTN; PAM sequence: TTC
aggtcgtgatggcctcgcaa

SEQ ID NO: 14515 - DNA, 20 bp, Artificial Sequence
  Description of Artificial Sequence: Synthetic oligonucleotide
  Target: SOD1; (-) strand; PAM type: YTN; PAM sequence: TTA
ttcaggtcgtgatggcctcg

SEQ ID NO: 14516 - DNA, 20 bp, Artificial Sequence
  Description of Artificial Sequence: Synthetic oligonucleotide
  Target: SOD1; (-) strand; PAM type: YTN; PAM sequence: TTG
agcattattcaggtcgtgat

SEQ ID NO: 14517 - DNA, 20 bp, Artificial Sequence
  Description of Artificial Sequence: Synthetic oligonucleotide
  Target: SOD1; (-) strand; PAM type: YTN; PAM sequence: CTG
aacattgagcattattcagg

SEQ ID NO: 14518 - DNA, 20 bp, Artificial Sequence
  Description of Artificial Sequence: Synthetic oligonucleotide
  Target: SOD1; (-) strand; PAM type: YTN; PAM sequence: TTG
gaagaatgaatagaaataat

SEQ ID NO: 14519 - DNA, 20 bp, Artificial Sequence
  Description of Artificial Sequence: Synthetic oligonucleotide
  Target: SOD1; (-) strand; PAM type: YTN; PAM sequence: TTT
ggaagaatgaatagaaataa

SEQ ID NO: 14520 - DNA, 20 bp, Artificial Sequence
  Description of Artificial Sequence: Synthetic oligonucleotide
  Target: SOD1; (-) strand; PAM type: YTN; PAM sequence: CTT
tggaagaatgaatagaaata

SEQ ID NO: 14521 - DNA, 20 bp, Artificial Sequence
  Description of Artificial Sequence: Synthetic oligonucleotide
  Target: SOD1; (-) strand; PAM type: YTN; PAM sequence: TTG
ccacctttggaagaatgaat

SEQ ID NO: 14522 - DNA, 20 bp, Artificial Sequence
  Description of Artificial Sequence: Synthetic oligonucleotide
  Target: SOD1; (-) strand; PAM type: YTN; PAM sequence: CTT
gccacctttggaagaatgaa

SEQ ID NO: 14523 - DNA, 20 bp, Artificial Sequence
  Description of Artificial Sequence: Synthetic oligonucleotide
  Target: SOD1; (-) strand; PAM type: YTN; PAM sequence: TTA
ccagacttgccacctttgga

SEQ ID NO: 14524 - DNA, 20 bp, Artificial Sequence
  Description of Artificial Sequence: Synthetic oligonucleotide
  Target: SOD1; (-) strand; PAM type: YTN; PAM sequence: CTT
accagacttgccacctttgg

SEQ ID NO: 14525 - DNA, 20 bp, Artificial Sequence
  Description of Artificial Sequence: Synthetic oligonucleotide
  Target: SOD1; (-) strand; PAM type: YTN; PAM sequence: TTC
agcagcaccaaccttaccag

SEQ ID NO: 14526 - DNA, 20 bp, Artificial Sequence
  Description of Artificial Sequence: Synthetic oligonucleotide
  Target: SOD1; (-) strand; PAM type: YTN; PAM sequence: TTT
cagcagcaccaaccttacca

SEQ ID NO: 14527 - DNA, 20 bp, Artificial Sequence
  Description of Artificial Sequence: Synthetic oligonucleotide
  Target: SOD1; (-) strand; PAM type: YTN; PAM sequence: TTA
tttcagcagcaccaacctta

SEQ ID NO: 14528 - DNA, 20 bp, Artificial Sequence
  Description of Artificial Sequence: Synthetic oligonucleotide
  Target: SOD1; (-) strand; PAM type: YTN; PAM sequence: TTG
ttatttcagcagcaccaacc

SEQ ID NO: 14529 - DNA, 20 bp, Artificial Sequence
  Description of Artificial Sequence: Synthetic oligonucleotide
  Target: SOD1; (-) strand; PAM type: YTN; PAM sequence: CTC
atgtagataggaaaataaaa

SEQ ID NO: 14530 - DNA, 20 bp, Artificial Sequence
  Description of Artificial Sequence: Synthetic oligonucleotide
  Target: SOD1; (-) strand; PAM type: YTN; PAM sequence: TTA
tatcagtatgagcaaaccct

SEQ ID NO: 14531 - DNA, 20 bp, Artificial Sequence
  Description of Artificial Sequence: Synthetic oligonucleotide
  Target: SOD1; (-) strand; PAM type: YTN; PAM sequence: CTT
atatcagtatgagcaaaccc

SEQ ID NO: 14532 - DNA, 20 bp, Artificial Sequence
  Description of Artificial Sequence: Synthetic oligonucleotide
  Target: SOD1; (-) strand; PAM type: YTN; PAM sequence: CTC
ttatatcagtatgagcaaac

SEQ ID NO: 14533 - DNA, 20 bp, Artificial Sequence
  Description of Artificial Sequence: Synthetic oligonucleotide
  Target: SOD1; (-) strand; PAM type: YTN; PAM sequence: TTG
cgtgactcttatatcagtat

SEQ ID NO: 14534 - DNA, 20 bp, Artificial Sequence
  Description of Artificial Sequence: Synthetic oligonucleotide
  Target: SOD1; (-) strand; PAM type: YTN; PAM sequence: CTT
gcgtgactcttatatcagta

SEQ ID NO: 14535 - DNA, 20 bp, Artificial Sequence
  Description of Artificial Sequence: Synthetic oligonucleotide
  Target: SOD1; (-) strand; PAM type: YTN; PAM sequence: TTG
aacttgcgtgactcttatat

SEQ ID NO: 14536 - DNA, 20 bp, Artificial Sequence
  Description of Artificial Sequence: Synthetic oligonucleotide
  Target: SOD1; (-) strand; PAM type: YTN; PAM sequence: TTG
ttgaacttgcgtgactctta

SEQ ID NO: 14537 - DNA, 20 bp, Artificial Sequence
  Description of Artificial Sequence: Synthetic oligonucleotide
  Target: SOD1; (-) strand; PAM type: YTN; PAM sequence: CTA
agtggtgaaccccaagcaga

SEQ ID NO: 14538 - DNA, 20 bp, Artificial Sequence
  Description of Artificial Sequence: Synthetic oligonucleotide
  Target: SOD1; (-) strand; PAM type: YTN; PAM sequence: CTG
tacctaagtggtgaacccca

SEQ ID NO: 14539 - DNA, 20 bp, Artificial Sequence
  Description of Artificial Sequence: Synthetic oligonucleotide
  Target: SOD1; (-) strand; PAM type: YTN; PAM sequence: TTC
tgtacctaagtggtgaaccc

SEQ ID NO: 14540 - DNA, 20 bp, Artificial Sequence
  Description of Artificial Sequence: Synthetic oligonucleotide
  Target: SOD1; (-) strand; PAM type: YTN; PAM sequence: TTT
ctgtacctaagtggtgaacc

SEQ ID NO: 14541 - DNA, 20 bp, Artificial Sequence
  Description of Artificial Sequence: Synthetic oligonucleotide
  Target: SOD1; (-) strand; PAM type: YTN; PAM sequence: TTT
tctgtacctaagtggtgaac

SEQ ID NO: 14542 - DNA, 20 bp, Artificial Sequence
  Description of Artificial Sequence: Synthetic oligonucleotide
  Target: SOD1; (-) strand; PAM type: YTN; PAM sequence: CTT
ttctgtacctaagtggtgaa

SEQ ID NO: 14543 - DNA, 20 bp, Artificial Sequence
  Description of Artificial Sequence: Synthetic oligonucleotide
  Target: SOD1; (-) strand; PAM type: YTN; PAM sequence: TTC
caatgcttttctgtacctaa

SEQ ID NO: 14544 - DNA, 20 bp, Artificial Sequence
  Description of Artificial Sequence: Synthetic oligonucleotide
  Target: SOD1; (-) strand; PAM type: YTN; PAM sequence: TTG
agagattccaatgcttttct

SEQ ID NO: 14545 - DNA, 20 bp, Artificial Sequence
  Description of Artificial Sequence: Synthetic oligonucleotide
  Target: SOD1; (-) strand; PAM type: YTN; PAM sequence: TTG
caaaaggataaattgagaga

SEQ ID NO: 14546 - DNA, 20 bp, Artificial Sequence
  Description of Artificial Sequence: Synthetic oligonucleotide
  Target: SOD1; (-) strand; PAM type: YTN; PAM sequence: TTT
gcaaaaggataaattgagag

SEQ ID NO: 14547 - DNA, 20 bp, Artificial Sequence
  Description of Artificial Sequence: Synthetic oligonucleotide
  Target: SOD1; (-) strand; PAM type: YTN; PAM sequence: TTA
tatttgcaaaaggataaatt

SEQ ID NO: 14548 - DNA, 20 bp, Artificial Sequence
  Description of Artificial Sequence: Synthetic oligonucleotide
  Target: SOD1; (-) strand; PAM type: YTN; PAM sequence: TTT
atatttgcaaaaggataaat

SEQ ID NO: 14549 - DNA, 20 bp, Artificial Sequence
  Description of Artificial Sequence: Synthetic oligonucleotide
  Target: SOD1; (-) strand; PAM type: YTN; PAM sequence: TTA
tttatatttgcaaaaggata

SEQ ID NO: 14550 - DNA, 20 bp, Artificial Sequence
  Description of Artificial Sequence: Synthetic oligonucleotide
  Target: SOD1; (-) strand; PAM type: YTN; PAM sequence: CTT
atttatatttgcaaaaggat

SEQ ID NO: 14551 - DNA, 20 bp, Artificial Sequence
  Description of Artificial Sequence: Synthetic oligonucleotide
  Target: SOD1; (-) strand; PAM type: YTN; PAM sequence: TTG
tcttatttatatttgcaaaa

SEQ ID NO: 14552 - DNA, 20 bp, Artificial Sequence
  Description of Artificial Sequence: Synthetic oligonucleotide
  Target: SOD1; (-) strand; PAM type: YTN; PAM sequence: TTT
gtcttatttatatttgcaaa

SEQ ID NO: 14553 - DNA, 20 bp, Artificial Sequence
  Description of Artificial Sequence: Synthetic oligonucleotide
  Target: SOD1; (-) strand; PAM type: YTN; PAM sequence: TTA
tagtatttgtcttatttata

SEQ ID NO: 14554 - DNA, 20 bp, Artificial Sequence
  Description of Artificial Sequence: Synthetic oligonucleotide
  Target: SOD1; (-) strand; PAM type: YTN; PAM sequence: TTC
aatcatagtattatagtatt

SEQ ID NO: 14555 - DNA, 20 bp, Artificial Sequence
  Description of Artificial Sequence: Synthetic oligonucleotide
  Target: SOD1; (-) strand; PAM type: YTN; PAM sequence: TTT
caatcatagtattatagtat

SEQ ID NO: 14556 - DNA, 20 bp, Artificial Sequence
  Description of Artificial Sequence: Synthetic oligonucleotide
  Target: SOD1; (-) strand; PAM type: YTN; PAM sequence: CTT
tcaatcatagtattatagta

SEQ ID NO: 14557 - DNA, 20 bp, Artificial Sequence
  Description of Artificial Sequence: Synthetic oligonucleotide
  Target: SOD1; (-) strand; PAM type: YTN; PAM sequence: CTC
ctttcaatcatagtattata

SEQ ID NO: 14558 - DNA, 20 bp, Artificial Sequence
  Description of Artificial Sequence: Synthetic oligonucleotide
  Target: SOD1; (-) strand; PAM type: YTN; PAM sequence: TTA
tcagaataactcctttcaat

SEQ ID NO: 14559 - DNA, 20 bp, Artificial Sequence
  Description of Artificial Sequence: Synthetic oligonucleotide
  Target: SOD1; (-) strand; PAM type: YTN; PAM sequence: TTC
cattatcagaataactcctt

SEQ ID NO: 14560 - DNA, 20 bp, Artificial Sequence
  Description of Artificial Sequence: Synthetic oligonucleotide
  Target: SOD1; (-) strand; PAM type: YTN; PAM sequence: TTT
ccattatcagaataactcct

SEQ ID NO: 14561 - DNA, 20 bp, Artificial Sequence
  Description of Artificial Sequence: Synthetic oligonucleotide
  Target: SOD1; (-) strand; PAM type: YTN; PAM sequence: TTT
tccattatcagaataactcc

SEQ ID NO: 14562 - DNA, 20 bp, Artificial Sequence
  Description of Artificial Sequence: Synthetic oligonucleotide
  Target: SOD1; (-) strand; PAM type: YTN; PAM sequence: CTG
gaacattttccattatcaga

SEQ ID NO: 14563 - DNA, 20 bp, Artificial Sequence
  Description of Artificial Sequence: Synthetic oligonucleotide
  Target: SOD1; (-) strand; PAM type: YTN; PAM sequence: TTA
acagtacctggaacattttc

SEQ ID NO: 14564 - DNA, 20 bp, Artificial Sequence
  Description of Artificial Sequence: Synthetic oligonucleotide
  Target: SOD1; (-) strand; PAM type: YTN; PAM sequence: CTT
aacagtacctggaacatttt

SEQ ID NO: 14565 - DNA, 20 bp, Artificial Sequence
  Description of Artificial Sequence: Synthetic oligonucleotide
  Target: SOD1; (-) strand; PAM type: YTN; PAM sequence: TTC
ttaacagtacctggaacatt

SEQ ID NO: 14566 - DNA, 20 bp, Artificial Sequence
  Description of Artificial Sequence: Synthetic oligonucleotide
  Target: SOD1; (-) strand; PAM type: YTN; PAM sequence: CTG
cagcacatgggtaaatagca

SEQ ID NO: 14567 - DNA, 20 bp, Artificial Sequence
  Description of Artificial Sequence: Synthetic oligonucleotide
  Target: SOD1; (-) strand; PAM type: YTN; PAM sequence: TTC
tgcagcacatgggtaaatag

SEQ ID NO: 14568 - DNA, 20 bp, Artificial Sequence
  Description of Artificial Sequence: Synthetic oligonucleotide
  Target: SOD1; (-) strand; PAM type: YTN; PAM sequence: TTT
ctgcagcacatgggtaaata

SEQ ID NO: 14569 - DNA, 20 bp, Artificial Sequence
  Description of Artificial Sequence: Synthetic oligonucleotide
  Target: SOD1; (-) strand; PAM type: YTN; PAM sequence: CTT
tctgcagcacatgggtaaat

SEQ ID NO: 14570 - DNA, 20 bp, Artificial Sequence
  Description of Artificial Sequence: Synthetic oligonucleotide
  Target: SOD1; (-) strand; PAM type: YTN; PAM sequence: CTC
aaagacctttctgcagcaca

SEQ ID NO: 14571 - DNA, 20 bp, Artificial Sequence
  Description of Artificial Sequence: Synthetic oligonucleotide
  Target: SOD1; (-) strand; PAM type: YTN; PAM sequence: TTG
ctcaaagacctttctgcagc

SEQ ID NO: 14572 - DNA, 20 bp, Artificial Sequence
  Description of Artificial Sequence: Synthetic oligonucleotide
  Target: SOD1; (-) strand; PAM type: YTN; PAM sequence: CTT
gctcaaagacctttctgcag

SEQ ID NO: 14573 - DNA, 20 bp, Artificial Sequence
  Description of Artificial Sequence: Synthetic oligonucleotide
  Target: SOD1; (-) strand; PAM type: YTN; PAM sequence: CTG
atcataacccataacttgct

SEQ ID NO: 14574 - DNA, 20 bp, Artificial Sequence
  Description of Artificial Sequence: Synthetic oligonucleotide
  Target: SOD1; (-) strand; PAM type: YTN; PAM sequence: CTA
actgatcataacccataact

SEQ ID NO: 14575 - DNA, 20 bp, Artificial Sequence
  Description of Artificial Sequence: Synthetic oligonucleotide
  Target: SOD1; (-) strand; PAM type: YTN; PAM sequence: TTG
ctaactgatcataacccata

SEQ ID NO: 14576 - DNA, 20 bp, Artificial Sequence
  Description of Artificial Sequence: Synthetic oligonucleotide
  Target: SOD1; (-) strand; PAM type: YTN; PAM sequence: TTA
ccattgctaactgatcataa

SEQ ID NO: 14577 - DNA, 20 bp, Artificial Sequence
  Description of Artificial Sequence: Synthetic oligonucleotide
  Target: SOD1; (-) strand; PAM type: YTN; PAM sequence: CTT
accattgctaactgatcata

SEQ ID NO: 14578 - DNA, 20 bp, Artificial Sequence
  Description of Artificial Sequence: Synthetic oligonucleotide
  Target: SOD1; (-) strand; PAM type: YTN; PAM sequence: TTC
ttaccattgctaactgatca

SEQ ID NO: 14579 - DNA, 20 bp, Artificial Sequence
  Description of Artificial Sequence: Synthetic oligonucleotide
  Target: SOD1; (-) strand; PAM type: YTN; PAM sequence: TTT
cttaccattgctaactgatc

SEQ ID NO: 14580 - DNA, 20 bp, Artificial Sequence
  Description of Artificial Sequence: Synthetic oligonucleotide
  Target: SOD1; (-) strand; PAM type: YTN; PAM sequence: TTT
tcttaccattgctaactgat

SEQ ID NO: 14581 - DNA, 20 bp, Artificial Sequence
  Description of Artificial Sequence: Synthetic oligonucleotide
  Target: SOD1; (-) strand; PAM type: YTN; PAM sequence: TTT
ttcttaccattgctaactga

SEQ ID NO: 14582 - DNA, 20 bp, Artificial Sequence
  Description of Artificial Sequence: Synthetic oligonucleotide
  Target: SOD1; (-) strand; PAM type: YTN; PAM sequence: CTG
tcagtgtcacccaagtattt

SEQ ID NO: 14583 - DNA, 20 bp, Artificial Sequence
  Description of Artificial Sequence: Synthetic oligonucleotide
  Target: SOD1; (-) strand; PAM type: YTN; PAM sequence: TTC
tgtcagtgtcacccaagtat

SEQ ID NO: 14584 - DNA, 20 bp, Artificial Sequence
  Description of Artificial Sequence: Synthetic oligonucleotide
  Target: SOD1; (-) strand; PAM type: YTN; PAM sequence: TTT
ctgtcagtgtcacccaagta

SEQ ID NO: 14585 - DNA, 20 bp, Artificial Sequence
  Description of Artificial Sequence: Synthetic oligonucleotide
  Target: SOD1; (-) strand; PAM type: YTN; PAM sequence: TTT
tctgtcagtgtcacccaagt

SEQ ID NO: 14586 - DNA, 20 bp, Artificial Sequence
  Description of Artificial Sequence: Synthetic oligonucleotide
  Target: SOD1; (-) strand; PAM type: YTN; PAM sequence: TTT
ttctgtcagtgtcacccaag

SEQ ID NO: 14587 - DNA, 20 bp, Artificial Sequence
  Description of Artificial Sequence: Synthetic oligonucleotide
  Target: SOD1; (-) strand; PAM type: YTN; PAM sequence: TTG
gtcatttttctgtcagtgtc

SEQ ID NO: 14588 - DNA, 20 bp, Artificial Sequence
  Description of Artificial Sequence: Synthetic oligonucleotide
  Target: SOD1; (-) strand; PAM type: YTN; PAM sequence: TTC
ccaattggtcatttttctgt

SEQ ID NO: 14589 - DNA, 20 bp, Artificial Sequence
  Description of Artificial Sequence: Synthetic oligonucleotide
  Target: SOD1; (-) strand; PAM type: YTN; PAM sequence: TTT
cccaattggtcatttttctg

SEQ ID NO: 14590 - DNA, 20 bp, Artificial Sequence
  Description of Artificial Sequence: Synthetic oligonucleotide
  Target: SOD1; (-) strand; PAM type: YTN; PAM sequence: CTG
tggtaatcagcatttcccaa

SEQ ID NO: 14591 - DNA, 20 bp, Artificial Sequence
  Description of Artificial Sequence: Synthetic oligonucleotide
  Target: SOD1; (-) strand; PAM type: YTN; PAM sequence: TTG
ctgtggtaatcagcatttcc

SEQ ID NO: 14592 - DNA, 20 bp, Artificial Sequence
  Description of Artificial Sequence: Synthetic oligonucleotide
  Target: SOD1; (-) strand; PAM type: YTN; PAM sequence: TTT
gctgtggtaatcagcatttc

SEQ ID NO: 14593 - DNA, 20 bp, Artificial Sequence
  Description of Artificial Sequence: Synthetic oligonucleotide
  Target: SOD1; (-) strand; PAM type: YTN; PAM sequence: TTT
tgctgtggtaatcagcattt

SEQ ID NO: 14594 - DNA, 20 bp, Artificial Sequence
  Description of Artificial Sequence: Synthetic oligonucleotide
  Target: SOD1; (-) strand; PAM type: YTN; PAM sequence: CTT
ttgctgtggtaatcagcatt

SEQ ID NO: 14595 - DNA, 20 bp, Artificial Sequence
  Description of Artificial Sequence: Synthetic oligonucleotide
  Target: SOD1; (-) strand; PAM type: YTN; PAM sequence: CTG
gcgcttttgctgtggtaatc

SEQ ID NO: 14596 - DNA, 20 bp, Artificial Sequence
  Description of Artificial Sequence: Synthetic oligonucleotide
  Target: SOD1; (-) strand; PAM type: YTN; PAM sequence: TTC
tggcgcttttgctgtggtaa

SEQ ID NO: 14597 - DNA, 20 bp, Artificial Sequence
  Description of Artificial Sequence: Synthetic oligonucleotide
  Target: SOD1; (-) strand; PAM type: YTN; PAM sequence: TTT
ctggcgcttttgctgtggta

SEQ ID NO: 14598 - DNA, 20 bp, Artificial Sequence
  Description of Artificial Sequence: Synthetic oligonucleotide
  Target: SOD1; (-) strand; PAM type: YTN; PAM sequence: TTC
acaatttctggcgcttttgc

SEQ ID NO: 14599 - DNA, 20 bp, Artificial Sequence
  Description of Artificial Sequence: Synthetic oligonucleotide
  Target: SOD1; (-) strand; PAM type: YTN; PAM sequence: TTT
cacaatttctggcgcttttg

SEQ ID NO: 14600 - DNA, 20 bp, Artificial Sequence
  Description of Artificial Sequence: Synthetic oligonucleotide
  Target: SOD1; (-) strand; PAM type: YTN; PAM sequence: CTC
atccatttcacaatttctgg

SEQ ID NO: 14601 - DNA, 20 bp, Artificial Sequence
  Description of Artificial Sequence: Synthetic oligonucleotide
  Target: SOD1; (-) strand; PAM type: YTN; PAM sequence: CTG
tgaagggacagagccatcac

SEQ ID NO: 14602 - DNA, 20 bp, Artificial Sequence
  Description of Artificial Sequence: Synthetic oligonucleotide
  Target: SOD1; (-) strand; PAM type: YTN; PAM sequence: CTG
aagagcctgtgaagggacag

SEQ ID NO: 14603 - DNA, 20 bp, Artificial Sequence
  Description of Artificial Sequence: Synthetic oligonucleotide
  Target: SOD1; (-) strand; PAM type: YTN; PAM sequence: TTC
ccaaagtgtctgaagagcct

SEQ ID NO: 14604 - DNA, 20 bp, Artificial Sequence
  Description of Artificial Sequence: Synthetic oligonucleotide
  Target: SOD1; (-) strand; PAM type: YTN; PAM sequence: TTT
cccaaagtgtctgaagagcc

SEQ ID NO: 14605 - DNA, 20 bp, Artificial Sequence
  Description of Artificial Sequence: Synthetic oligonucleotide
  Target: SOD1; (-) strand; PAM type: YTN; PAM sequence: TTT
tcccaaagtgtctgaagagc

SEQ ID NO: 14606 - DNA, 20 bp, Artificial Sequence
  Description of Artificial Sequence: Synthetic oligonucleotide
  Target: SOD1; (-) strand; PAM type: YTN; PAM sequence: TTG
ggattttcccaaagtgtctg

SEQ ID NO: 14607 - DNA, 20 bp, Artificial Sequence
  Description of Artificial Sequence: Synthetic oligonucleotide
  Target: SOD1; (-) strand; PAM type: YTN; PAM sequence: TTC
attgggattttcccaaagtg

SEQ ID NO: 14608 - DNA, 20 bp, Artificial Sequence
  Description of Artificial Sequence: Synthetic oligonucleotide
  Target: SOD1; (-) strand; PAM type: YTN; PAM sequence: TTG
ttcattgggattttcccaaa

SEQ ID NO: 14609 - DNA, 20 bp, Artificial Sequence
  Description of Artificial Sequence: Synthetic oligonucleotide
  Target: SOD1; (-) strand; PAM type: YTN; PAM sequence: CTT
gttcattgggattttcccaa

SEQ ID NO: 14610 - DNA, 20 bp, Artificial Sequence
  Description of Artificial Sequence: Synthetic oligonucleotide
  Target: SOD1; (-) strand; PAM type: YTN; PAM sequence: CTG
tacttgttcattgggatttt

SEQ ID NO: 14611 - DNA, 20 bp, Artificial Sequence
  Description of Artificial Sequence: Synthetic oligonucleotide
  Target: SOD1; (-) strand; PAM type: YTN; PAM sequence: CTG
gtgtcctgtacttgttcatt

SEQ ID NO: 14612 - DNA, 20 bp, Artificial Sequence
  Description of Artificial Sequence: Synthetic oligonucleotide
  Target: SOD1; (-) strand; PAM type: YTN; PAM sequence: CTG
agatacagtgtagctggtgt

SEQ ID NO: 14613 - DNA, 20 bp, Artificial Sequence
  Description of Artificial Sequence: Synthetic oligonucleotide
  Target: SOD1; (-) strand; PAM type: YTN; PAM sequence: CTA
tctgagatacagtgtagctg

SEQ ID NO: 14614 - DNA, 20 bp, Artificial Sequence
  Description of Artificial Sequence: Synthetic oligonucleotide
  Target: SOD1; (-) strand; PAM type: YTN; PAM sequence: TTC
tatctgagatacagtgtagc

SEQ ID NO: 14615 - DNA, 20 bp, Artificial Sequence
  Description of Artificial Sequence: Synthetic oligonucleotide
  Target: SOD1; (-) strand; PAM type: YTN; PAM sequence: TTT
ctatctgagatacagtgtag

SEQ ID NO: 14616 - DNA, 20 bp, Artificial Sequence
  Description of Artificial Sequence: Synthetic oligonucleotide
  Target: SOD1; (-) strand; PAM type: YTN; PAM sequence: TTA
tttctatctgagatacagtg

SEQ ID NO: 14617 - DNA, 20 bp, Artificial Sequence
  Description of Artificial Sequence: Synthetic oligonucleotide
  Target: SOD1; (-) strand; PAM type: YTN; PAM sequence: TTT
atttctatctgagatacagt

SEQ ID NO: 14618 - DNA, 20 bp, Artificial Sequence
  Description of Artificial Sequence: Synthetic oligonucleotide
  Target: SOD1; (-) strand; PAM type: YTN; PAM sequence: TTT
tatttctatctgagatacag

SEQ ID NO: 14619 - DNA, 20 bp, Artificial Sequence
  Description of Artificial Sequence: Synthetic oligonucleotide
  Target: SOD1; (-) strand; PAM type: YTN; PAM sequence: TTC
ccaaatgatgtgaagagtgt

SEQ ID NO: 14620 - DNA, 20 bp, Artificial Sequence
  Description of Artificial Sequence: Synthetic oligonucleotide
  Target: SOD1; (-) strand; PAM type: YTN; PAM sequence: TTT
cccaaatgatgtgaagagtg

SEQ ID NO: 14621 - DNA, 20 bp, Artificial Sequence
  Description of Artificial Sequence: Synthetic oligonucleotide
  Target: SOD1; (-) strand; PAM type: YTN; PAM sequence: CTC
ggtaaatatttcccaaatga

SEQ ID NO: 14622 - DNA, 20 bp, Artificial Sequence
  Description of Artificial Sequence: Synthetic oligonucleotide
  Target: SOD1; (-) strand; PAM type: YTN; PAM sequence: TTG
ccccagtgtatggtatatac

SEQ ID NO: 14623 - DNA, 20 bp, Artificial Sequence
  Description of Artificial Sequence: Synthetic oligonucleotide
  Target: SOD1; (-) strand; PAM type: YTN; PAM sequence: CTG
ttgccccagtgtatggtata

SEQ ID NO: 14624 - DNA, 20 bp, Artificial Sequence
  Description of Artificial Sequence: Synthetic oligonucleotide
  Target: SOD1; (-) strand; PAM type: YTN; PAM sequence: TTC
tgttgccccagtgtatggta

SEQ ID NO: 14625 - DNA, 20 bp, Artificial Sequence
  Description of Artificial Sequence: Synthetic oligonucleotide
  Target: SOD1; (-) strand; PAM type: YTN; PAM sequence: CTT
ctgttgccccagtgtatggt

SEQ ID NO: 14626 - DNA, 20 bp, Artificial Sequence
  Description of Artificial Sequence: Synthetic oligonucleotide
  Target: SOD1; (-) strand; PAM type: YTN; PAM sequence: TTA
caaagtgaaagcaaggacat

SEQ ID NO: 14627 - DNA, 20 bp, Artificial Sequence
  Description of Artificial Sequence: Synthetic oligonucleotide
  Target: SOD1; (-) strand; PAM type: YTN; PAM sequence: TTT
acaaagtgaaagcaaggaca

SEQ ID NO: 14628 - DNA, 20 bp, Artificial Sequence
  Description of Artificial Sequence: Synthetic oligonucleotide
  Target: SOD1; (-) strand; PAM type: YTN; PAM sequence: CTT
tacaaagtgaaagcaaggac

SEQ ID NO: 14629 - DNA, 20 bp, Artificial Sequence
  Description of Artificial Sequence: Synthetic oligonucleotide
  Target: SOD1; (-) strand; PAM type: YTN; PAM sequence: TTC
tttacaaagtgaaagcaagg

SEQ ID NO: 14630 - DNA, 20 bp, Artificial Sequence
  Description of Artificial Sequence: Synthetic oligonucleotide
  Target: SOD1; (-) strand; PAM type: YTN; PAM sequence: TTT
ctttacaaagtgaaagcaag

SEQ ID NO: 14631 - DNA, 20 bp, Artificial Sequence
  Description of Artificial Sequence: Synthetic oligonucleotide
  Target: SOD1; (-) strand; PAM type: YTN; PAM sequence: CTA
tttctttacaaagtgaaagc

SEQ ID NO: 14632 - DNA, 20 bp, Artificial Sequence
  Description of Artificial Sequence: Synthetic oligonucleotide
  Target: SOD1; (-) strand; PAM type: YTN; PAM sequence: CTA
cactatttctttacaaagtg

SEQ ID NO: 14633 - DNA, 20 bp, Artificial Sequence
  Description of Artificial Sequence: Synthetic oligonucleotide
  Target: SOD1; (-) strand; PAM type: YTN; PAM sequence: TTG
gaactacactatttctttac

SEQ ID NO: 14634 - DNA, 20 bp, Artificial Sequence
  Description of Artificial Sequence: Synthetic oligonucleotide
  Target: SOD1; (-) strand; PAM type: YTN; PAM sequence: TTA
aagtccacaggtgttggaac

SEQ ID NO: 14635 - DNA, 20 bp, Artificial Sequence
  Description of Artificial Sequence: Synthetic oligonucleotide
  Target: SOD1; (-) strand; PAM type: YTN; PAM sequence: TTG
gattaaagtccacaggtgtt

SEQ ID NO: 14636 - DNA, 20 bp, Artificial Sequence
  Description of Artificial Sequence: Synthetic oligonucleotide
  Target: SOD1; (-) strand; PAM type: YTN; PAM sequence: TTT
ggattaaagtccacaggtgt

SEQ ID NO: 14637 - DNA, 20 bp, Artificial Sequence
  Description of Artificial Sequence: Synthetic oligonucleotide
  Target: SOD1; (-) strand; PAM type: YTN; PAM sequence: TTT
tggattaaagtccacaggtg

SEQ ID NO: 14638 - DNA, 20 bp, Artificial Sequence
  Description of Artificial Sequence: Synthetic oligonucleotide
  Target: SOD1; (-) strand; PAM type: YTN; PAM sequence: TTA
tgttttggattaaagtccac

SEQ ID NO: 14639 - DNA, 20 bp, Artificial Sequence
  Description of Artificial Sequence: Synthetic oligonucleotide
  Target: SOD1; (-) strand; PAM type: YTN; PAM sequence: TTT
atgttttggattaaagtcca

SEQ ID NO: 14640 - DNA, 20 bp, Artificial Sequence
  Description of Artificial Sequence: Synthetic oligonucleotide
  Target: SOD1; (-) strand; PAM type: YTN; PAM sequence: TTT
tatgttttggattaaagtcc

SEQ ID NO: 14641 - DNA, 20 bp, Artificial Sequence
  Description of Artificial Sequence: Synthetic oligonucleotide
  Target: SOD1; (-) strand; PAM type: YTN; PAM sequence: CTG
ggcatatacattttatgttt

SEQ ID NO: 14642 - DNA, 20 bp, Artificial Sequence
  Description of Artificial Sequence: Synthetic oligonucleotide
  Target: SOD1; (-) strand; PAM type: YTN; PAM sequence: CTG
tgcctgggcatatacatttt

SEQ ID NO: 14643 - DNA, 20 bp, Artificial Sequence
  Description of Artificial Sequence: Synthetic oligonucleotide
  Target: SOD1; (-) strand; PAM type: YTN; PAM sequence: TTA
aaagagactgtgcctgggca

SEQ ID NO: 14644 - DNA, 20 bp, Artificial Sequence
  Description of Artificial Sequence: Synthetic oligonucleotide
  Target: SOD1; (-) strand; PAM type: YTN; PAM sequence: CTA
ttaaaagagactgtgcctgg

SEQ ID NO: 14645 - DNA, 20 bp, Artificial Sequence
  Description of Artificial Sequence: Synthetic oligonucleotide
  Target: SOD1; (-) strand; PAM type: YTN; PAM sequence: CTC
tattaaaagagactgtgcct

SEQ ID NO: 14646 - DNA, 20 bp, Artificial Sequence
  Description of Artificial Sequence: Synthetic oligonucleotide
  Target: SOD1; (-) strand; PAM type: YTN; PAM sequence: CTA
tataatgatccctctattaa

SEQ ID NO: 14647 - DNA, 20 bp, Artificial Sequence
  Description of Artificial Sequence: Synthetic oligonucleotide
  Target: SOD1; (-) strand; PAM type: YTN; PAM sequence: TTC
tatataatgatccctctatt

SEQ ID NO: 14648 - DNA, 20 bp, Artificial Sequence
  Description of Artificial Sequence: Synthetic oligonucleotide
  Target: SOD1; (-) strand; PAM type: YTN; PAM sequence: TTT
ctatataatgatccctctat

SEQ ID NO: 14649 - DNA, 20 bp, Artificial Sequence
  Description of Artificial Sequence: Synthetic oligonucleotide
  Target: SOD1; (-) strand; PAM type: YTN; PAM sequence: TTC
aggtgtttctatataatgat

SEQ ID NO: 14650 - DNA, 20 bp, Artificial Sequence
  Description of Artificial Sequence: Synthetic oligonucleotide
  Target: SOD1; (-) strand; PAM type: YTN; PAM sequence: TTT
caggtgtttctatataatga

SEQ ID NO: 14651 - DNA, 20 bp, Artificial Sequence
  Description of Artificial Sequence: Synthetic oligonucleotide
  Target: SOD1; (-) strand; PAM type: YTN; PAM sequence: TTG
tttcaggtgtttctatataa

SEQ ID NO: 14652 - DNA, 20 bp, Artificial Sequence
  Description of Artificial Sequence: Synthetic oligonucleotide
  Target: SOD1; (-) strand; PAM type: YTN; PAM sequence: TTT
gtttcaggtgtttctatata

SEQ ID NO: 14653 - DNA, 20 bp, Artificial Sequence
  Description of Artificial Sequence: Synthetic oligonucleotide
  Target: SOD1; (-) strand; PAM type: YTN; PAM sequence: TTC
agtttgtttcaggtgtttct

SEQ ID NO: 14654 - DNA, 20 bp, Artificial Sequence
  Description of Artificial Sequence: Synthetic oligonucleotide
  Target: SOD1; (-) strand; PAM type: YTN; PAM sequence: CTG
ataaaaggtaatgggaaagt

SEQ ID NO: 14655 - DNA, 20 bp, Artificial Sequence
  Description of Artificial Sequence: Synthetic oligonucleotide
  Target: SOD1; (-) strand; PAM type: YTN; PAM sequence: TTA
ctgataaaaggtaatgggaa

SEQ ID NO: 14656 - DNA, 20 bp, Artificial Sequence
  Description of Artificial Sequence: Synthetic oligonucleotide
  Target: SOD1; (-) strand; PAM type: YTN; PAM sequence: TTT
actgataaaaggtaatggga

SEQ ID NO: 14657 - DNA, 20 bp, Artificial Sequence
  Description of Artificial Sequence: Synthetic oligonucleotide
  Target: SOD1; (-) strand; PAM type: YTN; PAM sequence: CTT
tactgataaaaggtaatggg

SEQ ID NO: 14658 - DNA, 20 bp, Artificial Sequence
  Description of Artificial Sequence: Synthetic oligonucleotide
  Target: SOD1; (-) strand; PAM type: YTN; PAM sequence: CTG
gaaaacaaatctttactgat

SEQ ID NO: 14659 - DNA, 20 bp, Artificial Sequence
  Description of Artificial Sequence: Synthetic oligonucleotide
  Target: SOD1; (-) strand; PAM type: YTN; PAM sequence: TTA
gtcctggaaaacaaatcttt

SEQ ID NO: 14660 - DNA, 20 bp, Artificial Sequence
  Description of Artificial Sequence: Synthetic oligonucleotide
  Target: SOD1; (-) strand; PAM type: YTN; PAM sequence: TTT
agtcctggaaaacaaatctt

SEQ ID NO: 14661 - DNA, 20 bp, Artificial Sequence
  Description of Artificial Sequence: Synthetic oligonucleotide
  Target: SOD1; (-) strand; PAM type: YTN; PAM sequence: TTT
tagtcctggaaaacaaatct

SEQ ID NO: 14662 - DNA, 20 bp, Artificial Sequence
  Description of Artificial Sequence: Synthetic oligonucleotide
  Target: SOD1; (-) strand; PAM type: YTN; PAM sequence: TTG
gtcattttagtcctggaaaa

SEQ ID NO: 14663 - DNA, 20 bp, Artificial Sequence
  Description of Artificial Sequence: Synthetic oligonucleotide
  Target: SOD1; (-) strand; PAM type: YTN; PAM sequence: TTA
acagtaaacattggtcattt

SEQ ID NO: 14664 - DNA, 20 bp, Artificial Sequence
  Description of Artificial Sequence: Synthetic oligonucleotide
  Target: SOD1; (-) strand; PAM type: YTN; PAM sequence: CTC
cgttaacagtaaacattggt

SEQ ID NO: 14665 - DNA, 20 bp, Artificial Sequence
  Description of Artificial Sequence: Synthetic oligonucleotide
  Target: SOD1; (-) strand; PAM type: YTN; PAM sequence: CTG
acctccgttaacagtaaaca

SEQ ID NO: 14666 - DNA, 20 bp, Artificial Sequence
  Description of Artificial Sequence: Synthetic oligonucleotide
  Target: SOD1; (-) strand; PAM type: YTN; PAM sequence: CTA
tgctgacctccgttaacagt

SEQ ID NO: 14667 - DNA, 20 bp, Artificial Sequence
  Description of Artificial Sequence: Synthetic oligonucleotide
  Target: SOD1; (-) strand; PAM type: YTN; PAM sequence: TTC
tatgctgacctccgttaaca

SEQ ID NO: 14668 - DNA, 20 bp, Artificial Sequence
  Description of Artificial Sequence: Synthetic oligonucleotide
  Target: SOD1; (+) strand; PAM type: YTN; PAM sequence: CTG
ggtgacgccagctgggctcc

SEQ ID NO: 14669 - DNA, 20 bp, Artificial Sequence
  Description of Artificial Sequence: Synthetic oligonucleotide
  Target: SOD1; (+) strand; PAM type: YTN; PAM sequence: CTG
ggctcctgagtttagtgggg

SEQ ID NO: 14670 - DNA, 20 bp, Artificial Sequence
  Description of Artificial Sequence: Synthetic oligonucleotide
  Target: SOD1; (+) strand; PAM type: YTN; PAM sequence: CTC
ctgagtttagtggggacctg

SEQ ID NO: 14671 - DNA, 20 bp, Artificial Sequence
  Description of Artificial Sequence: Synthetic oligonucleotide
  Target: SOD1; (+) strand; PAM type: YTN; PAM sequence: CTG
agtttagtggggacctgcag

SEQ ID NO: 14672 - DNA, 20 bp, Artificial Sequence
  Description of Artificial Sequence: Synthetic oligonucleotide
  Target: SOD1; (+) strand; PAM type: YTN; PAM sequence: TTT
agtggggacctgcagaacct

SEQ ID NO: 14673 - DNA, 20 bp, Artificial Sequence
  Description of Artificial Sequence: Synthetic oligonucleotide
  Target: SOD1; (+) strand; PAM type: YTN; PAM sequence: TTA
gtggggacctgcagaacctt

SEQ ID NO: 14674 - DNA, 20 bp, Artificial Sequence
  Description of Artificial Sequence: Synthetic oligonucleotide
  Target: SOD1; (+) strand; PAM type: YTN; PAM sequence: CTG
cagaacctttatgtctagct

SEQ ID NO: 14675 - DNA, 20 bp, Artificial Sequence
  Description of Artificial Sequence: Synthetic oligonucleotide
  Target: SOD1; (+) strand; PAM type: YTN; PAM sequence: CTT
tatgtctagctaagggattg

SEQ ID NO: 14676 - DNA, 20 bp, Artificial Sequence
  Description of Artificial Sequence: Synthetic oligonucleotide
  Target: SOD1; (+) strand; PAM type: YTN; PAM sequence: TTT
atgtctagctaagggattgt

SEQ ID NO: 14677 - DNA, 20 bp, Artificial Sequence
  Description of Artificial Sequence: Synthetic oligonucleotide
  Target: SOD1; (+) strand; PAM type: YTN; PAM sequence: TTA
tgtctagctaagggattgta

SEQ ID NO: 14678 - DNA, 20 bp, Artificial Sequence
  Description of Artificial Sequence: Synthetic oligonucleotide
  Target: SOD1; (+) strand; PAM type: YTN; PAM sequence: CTA
gctaagggattgtaaatgca

SEQ ID NO: 14679 - DNA, 20 bp, Artificial Sequence
  Description of Artificial Sequence: Synthetic oligonucleotide
  Target: SOD1; (+) strand; PAM type: YTN; PAM sequence: CTA
agggattgtaaatgcaccaa

SEQ ID NO: 14680 - DNA, 20 bp, Artificial Sequence
  Description of Artificial Sequence: Synthetic oligonucleotide
  Target: SOD1; (+) strand; PAM type: YTN; PAM sequence: TTG
taaatgcaccaatcggcacc

SEQ ID NO: 14681 - DNA, 20 bp, Artificial Sequence
  Description of Artificial Sequence: Synthetic oligonucleotide
  Target: SOD1; (+) strand; PAM type: YTN; PAM sequence: CTG
tgtctagctcagggtttgtg

SEQ ID NO: 14682 - DNA, 20 bp, Artificial Sequence
  Description of Artificial Sequence: Synthetic oligonucleotide
  Target: SOD1; (+) strand; PAM type: YTN; PAM sequence: CTA
gctcagggtttgtgaatgca

SEQ ID NO: 14683 - DNA, 20 bp, Artificial Sequence
  Description of Artificial Sequence: Synthetic oligonucleotide
  Target: SOD1; (+) strand; PAM type: YTN; PAM sequence: CTC
agggtttgtgaatgcacgaa

SEQ ID NO: 14684 - DNA, 20 bp, Artificial Sequence
  Description of Artificial Sequence: Synthetic oligonucleotide
  Target: SOD1; (+) strand; PAM type: YTN; PAM sequence: TTT
gtgaatgcacgaatcgacac

SEQ ID NO: 14685 - DNA, 20 bp, Artificial Sequence
  Description of Artificial Sequence: Synthetic oligonucleotide
  Target: SOD1; (+) strand; PAM type: YTN; PAM sequence: TTG
tgaatgcacgaatcgacact

SEQ ID NO: 14686 - DNA, 20 bp, Artificial Sequence
  Description of Artificial Sequence: Synthetic oligonucleotide
  Target: SOD1; (+) strand; PAM type: YTN; PAM sequence: CTC
tgtatctagctactctggtg

SEQ ID NO: 14687 - DNA, 20 bp, Artificial Sequence
  Description of Artificial Sequence: Synthetic oligonucleotide
  Target: SOD1; (+) strand; PAM type: YTN; PAM sequence: CTG
tatctagctactctggtggg

SEQ ID NO: 14688 - DNA, 20 bp, Artificial Sequence
  Description of Artificial Sequence: Synthetic oligonucleotide
  Target: SOD1; (+) strand; PAM type: YTN; PAM sequence: CTA
gctactctggtggggaggtg

SEQ ID NO: 14689 - DNA, 20 bp, Artificial Sequence
  Description of Artificial Sequence: Synthetic oligonucleotide
  Target: SOD1; (+) strand; PAM type: YTN; PAM sequence: CTA
ctctggtggggaggtggaga

SEQ ID NO: 14690 - DNA, 20 bp, Artificial Sequence
  Description of Artificial Sequence: Synthetic oligonucleotide
  Target: SOD1; (+) strand; PAM type: YTN; PAM sequence: CTC
tggtggggaggtggagaacc

SEQ ID NO: 14691 - DNA, 20 bp, Artificial Sequence
  Description of Artificial Sequence: Synthetic oligonucleotide
  Target: SOD1; (+) strand; PAM type: YTN; PAM sequence: CTG
gtggggaggtggagaacctt

SEQ ID NO: 14692 - DNA, 20 bp, Artificial Sequence
  Description of Artificial Sequence: Synthetic oligonucleotide
  Target: SOD1; (+) strand; PAM type: YTN; PAM sequence: CTT
tgtgtctagctcagggattg

SEQ ID NO: 14693 - DNA, 20 bp, Artificial Sequence
  Description of Artificial Sequence: Synthetic oligonucleotide
  Target: SOD1; (+) strand; PAM type: YTN; PAM sequence: TTT
gtgtctagctcagggattgt

SEQ ID NO: 14694 - DNA, 20 bp, Artificial Sequence
  Description of Artificial Sequence: Synthetic oligonucleotide
  Target: SOD1; (+) strand; PAM type: YTN; PAM sequence: TTG
tgtctagctcagggattgta

SEQ ID NO: 14695 - DNA, 20 bp, Artificial Sequence
  Description of Artificial Sequence: Synthetic oligonucleotide
  Target: SOD1; (+) strand; PAM type: YTN; PAM sequence: CTA
gctcagggattgtaaacaca

SEQ ID NO: 14696 - DNA, 20 bp, Artificial Sequence
  Description of Artificial Sequence: Synthetic oligonucleotide
  Target: SOD1; (+) strand; PAM type: YTN; PAM sequence: CTC
agggattgtaaacacaccaa

SEQ ID NO: 14697 - DNA, 20 bp, Artificial Sequence
  Description of Artificial Sequence: Synthetic oligonucleotide
  Target: SOD1; (+) strand; PAM type: YTN; PAM sequence: TTG
taaacacaccaatcagcgcc

SEQ ID NO: 14698 - DNA, 20 bp, Artificial Sequence
  Description of Artificial Sequence: Synthetic oligonucleotide
  Target: SOD1; (+) strand; PAM type: YTN; PAM sequence: CTG
tcaaaacagaccactcggct

SEQ ID NO: 14699 - DNA, 20 bp, Artificial Sequence
  Description of Artificial Sequence: Synthetic oligonucleotide
  Target: SOD1; (+) strand; PAM type: YTN; PAM sequence: CTC
ggctctaccaatcagcagga

SEQ ID NO: 14700 - DNA, 20 bp, Artificial Sequence
  Description of Artificial Sequence: Synthetic oligonucleotide
  Target: SOD1; (+) strand; PAM type: YTN; PAM sequence: CTC
taccaatcagcaggatgtgg

SEQ ID NO: 14701 - DNA, 20 bp, Artificial Sequence
  Description of Artificial Sequence: Synthetic oligonucleotide
  Target: SOD1; (+) strand; PAM type: YTN; PAM sequence: CTA
ccaatcagcaggatgtgggt

SEQ ID NO: 14702 - DNA, 20 bp, Artificial Sequence
  Description of Artificial Sequence: Synthetic oligonucleotide
  Target: SOD1; (+) strand; PAM type: YTN; PAM sequence: CTG
cctgagccagcagtggcaag

SEQ ID NO: 14703 - DNA, 20 bp, Artificial Sequence
  Description of Artificial Sequence: Synthetic oligonucleotide
  Target: SOD1; (+) strand; PAM type: YTN; PAM sequence: CTG
agccagcagtggcaagctgc

SEQ ID NO: 14704 - DNA, 20 bp, Artificial Sequence
  Description of Artificial Sequence: Synthetic oligonucleotide
  Target: SOD1; (+) strand; PAM type: YTN; PAM sequence: CTG
cttgggtccccttccatact

SEQ ID NO: 14705 - DNA, 20 bp, Artificial Sequence
  Description of Artificial Sequence: Synthetic oligonucleotide
  Target: SOD1; (+) strand; PAM type: YTN; PAM sequence: CTT
gggtccccttccatactgtg

SEQ ID NO: 14706 - DNA, 20 bp, Artificial Sequence
  Description of Artificial Sequence: Synthetic oligonucleotide
  Target: SOD1; (+) strand; PAM type: YTN; PAM sequence: TTG
ggtccccttccatactgtgg

SEQ ID NO: 14707 - DNA, 20 bp, Artificial Sequence
  Description of Artificial Sequence: Synthetic oligonucleotide
  Target: SOD1; (+) strand; PAM type: YTN; PAM sequence: CTT
ccatactgtggaagctttgt

SEQ ID NO: 14708 - DNA, 20 bp, Artificial Sequence
  Description of Artificial Sequence: Synthetic oligonucleotide
  Target: SOD1; (+) strand; PAM type: YTN; PAM sequence: TTC
catactgtggaagctttgtc

SEQ ID NO: 14709 - DNA, 20 bp, Artificial Sequence
  Description of Artificial Sequence: Synthetic oligonucleotide
  Target: SOD1; (+) strand; PAM type: YTN; PAM sequence: CTG
tggaagctttgtctttcttt

SEQ ID NO: 14710 - DNA, 20 bp, Artificial Sequence
  Description of Artificial Sequence: Synthetic oligonucleotide
  Target: SOD1; (+) strand; PAM type: YTN; PAM sequence: CTT
tgtctttctttgcaataaat

SEQ ID NO: 14711 - DNA, 20 bp, Artificial Sequence
  Description of Artificial Sequence: Synthetic oligonucleotide
  Target: SOD1; (+) strand; PAM type: YTN; PAM sequence: TTT
gtctttctttgcaataaatc

SEQ ID NO: 14712 - DNA, 20 bp, Artificial Sequence
  Description of Artificial Sequence: Synthetic oligonucleotide
  Target: SOD1; (+) strand; PAM type: YTN; PAM sequence: TTG
tctttctttgcaataaatct

SEQ ID NO: 14713 - DNA, 20 bp, Artificial Sequence
  Description of Artificial Sequence: Synthetic oligonucleotide
  Target: SOD1; (+) strand; PAM type: YTN; PAM sequence: CTT
tctttgcaataaatcttgct

SEQ ID NO: 14714 - DNA, 20 bp, Artificial Sequence
  Description of Artificial Sequence: Synthetic oligonucleotide
  Target: SOD1; (+) strand; PAM type: YTN; PAM sequence: TTT
ctttgcaataaatcttgctg

SEQ ID NO: 14715 - DNA, 20 bp, Artificial Sequence
  Description of Artificial Sequence: Synthetic oligonucleotide
  Target: SOD1; (+) strand; PAM type: YTN; PAM sequence: TTC
tttgcaataaatcttgctgc

SEQ ID NO: 14716 - DNA, 20 bp, Artificial Sequence
  Description of Artificial Sequence: Synthetic oligonucleotide
  Target: SOD1; (+) strand; PAM type: YTN; PAM sequence: CTT
tgcaataaatcttgctgctg

SEQ ID NO: 14717 - DNA, 20 bp, Artificial Sequence
  Description of Artificial Sequence: Synthetic oligonucleotide
  Target: SOD1; (+) strand; PAM type: YTN; PAM sequence: TTT
gcaataaatcttgctgctgc

SEQ ID NO: 14718 - DNA, 20 bp, Artificial Sequence
  Description of Artificial Sequence: Synthetic oligonucleotide
  Target: SOD1; (+) strand; PAM type: YTN; PAM sequence: TTG
caataaatcttgctgctgct

SEQ ID NO: 14719 - DNA, 20 bp, Artificial Sequence
  Description of Artificial Sequence: Synthetic oligonucleotide
  Target: SOD1; (+) strand; PAM type: YTN; PAM sequence: CTT
gctgctgctcactctttggg

SEQ ID NO: 14720 - DNA, 20 bp, Artificial Sequence
  Description of Artificial Sequence: Synthetic oligonucleotide
  Target: SOD1; (+) strand; PAM type: YTN; PAM sequence: TTG
ctgctgctcactctttgggt

SEQ ID NO: 14721 - DNA, 20 bp, Artificial Sequence
  Description of Artificial Sequence: Synthetic oligonucleotide
  Target: SOD1; (+) strand; PAM type: YTN; PAM sequence: CTG
ctgctcactctttgggtcca

SEQ ID NO: 14722 - DNA, 20 bp, Artificial Sequence
  Description of Artificial Sequence: Synthetic oligonucleotide
  Target: SOD1; (+) strand; PAM type: YTN; PAM sequence: CTG
ctcactctttgggtccacac

SEQ ID NO: 14723 - DNA, 20 bp, Artificial Sequence
  Description of Artificial Sequence: Synthetic oligonucleotide
  Target: SOD1; (+) strand; PAM type: YTN; PAM sequence: CTC
actctttgggtccacactgc

SEQ ID NO: 14724 - DNA, 20 bp, Artificial Sequence
  Description of Artificial Sequence: Synthetic oligonucleotide
  Target: SOD1; (+) strand; PAM type: YTN; PAM sequence: CTC
tttgggtccacactgccttt

SEQ ID NO: 14725 - DNA, 20 bp, Artificial Sequence
  Description of Artificial Sequence: Synthetic oligonucleotide
  Target: SOD1; (+) strand; PAM type: YTN; PAM sequence: CTT
tgggtccacactgcctttat

SEQ ID NO: 14726 - DNA, 20 bp, Artificial Sequence
  Description of Artificial Sequence: Synthetic oligonucleotide
  Target: SOD1; (+) strand; PAM type: YTN; PAM sequence: TTT
gggtccacactgcctttatg

SEQ ID NO: 14727 - DNA, 20 bp, Artificial Sequence
  Description of Artificial Sequence: Synthetic oligonucleotide
  Target: SOD1; (+) strand; PAM type: YTN; PAM sequence: TTG
ggtccacactgcctttatga

SEQ ID NO: 14728 - DNA, 20 bp, Artificial Sequence
  Description of Artificial Sequence: Synthetic oligonucleotide
  Target: SOD1; (+) strand; PAM type: YTN; PAM sequence: CTG
cctttatgagctgtaacact

SEQ ID NO: 14729 - DNA, 20 bp, Artificial Sequence
  Description of Artificial Sequence: Synthetic oligonucleotide
  Target: SOD1; (+) strand; PAM type: YTN; PAM sequence: CTT
tatgagctgtaacactcacc

SEQ ID NO: 14730 - DNA, 20 bp, Artificial Sequence
  Description of Artificial Sequence: Synthetic oligonucleotide
  Target: SOD1; (+) strand; PAM type: YTN; PAM sequence: TTT
atgagctgtaacactcacca

SEQ ID NO: 14731 - DNA, 20 bp, Artificial Sequence
  Description of Artificial Sequence: Synthetic oligonucleotide
  Target: SOD1; (+) strand; PAM type: YTN; PAM sequence: TTA
tgagctgtaacactcaccac

SEQ ID NO: 14732 - DNA, 20 bp, Artificial Sequence
  Description of Artificial Sequence: Synthetic oligonucleotide
  Target: SOD1; (+) strand; PAM type: YTN; PAM sequence: CTG
taacactcaccacgaaggtc

SEQ ID NO: 14733 - DNA, 20 bp, Artificial Sequence
  Description of Artificial Sequence: Synthetic oligonucleotide
  Target: SOD1; (+) strand; PAM type: YTN; PAM sequence: CTC
accacgaaggtctgcagctt

SEQ ID NO: 14734 - DNA, 20 bp, Artificial Sequence
  Description of Artificial Sequence: Synthetic oligonucleotide
  Target: SOD1; (+) strand; PAM type: YTN; PAM sequence: CTG
cagcttcactgctgaagcca

SEQ ID NO: 14735 - DNA, 20 bp, Artificial Sequence
  Description of Artificial Sequence: Synthetic oligonucleotide
  Target: SOD1; (+) strand; PAM type: YTN; PAM sequence: CTT
cactgctgaagccaatgaga

SEQ ID NO: 14736 - DNA, 20 bp, Artificial Sequence
  Description of Artificial Sequence: Synthetic oligonucleotide
  Target: SOD1; (+) strand; PAM type: YTN; PAM sequence: TTC
actgctgaagccaatgagac

SEQ ID NO: 14737 - DNA, 20 bp, Artificial Sequence
  Description of Artificial Sequence: Synthetic oligonucleotide
  Target: SOD1; (+) strand; PAM type: YTN; PAM sequence: CTG
ctgaagccaatgagaccacg

SEQ ID NO: 14738 - DNA, 20 bp, Artificial Sequence
  Description of Artificial Sequence: Synthetic oligonucleotide
  Target: SOD1; (+) strand; PAM type: YTN; PAM sequence: CTG
aagccaatgagaccacgaac

SEQ ID NO: 14739 - DNA, 20 bp, Artificial Sequence
  Description of Artificial Sequence: Synthetic oligonucleotide
  Target: SOD1; (+) strand; PAM type: YTN; PAM sequence: CTT
gagacgcgctgccttaagag

SEQ ID NO: 14740 - DNA, 20 bp, Artificial Sequence
  Description of Artificial Sequence: Synthetic oligonucleotide
  Target: SOD1; (+) strand; PAM type: YTN; PAM sequence: TTG
agacgcgctgccttaagagc

SEQ ID NO: 14741 - DNA, 20 bp, Artificial Sequence
  Description of Artificial Sequence: Synthetic oligonucleotide
  Target: SOD1; (+) strand; PAM type: YTN; PAM sequence: CTG
ccttaagagctgtaacactc

SEQ ID NO: 14742 - DNA, 20 bp, Artificial Sequence
  Description of Artificial Sequence: Synthetic oligonucleotide
  Target: SOD1; (+) strand; PAM type: YTN; PAM sequence: CTT
aagagctgtaacactcaccg

SEQ ID NO: 14743 - DNA, 20 bp, Artificial Sequence
  Description of Artificial Sequence: Synthetic oligonucleotide
  Target: SOD1; (+) strand; PAM type: YTN; PAM sequence: TTA
agagctgtaacactcaccgc

SEQ ID NO: 14744 - DNA, 20 bp, Artificial Sequence
  Description of Artificial Sequence: Synthetic oligonucleotide
  Target: SOD1; (+) strand; PAM type: YTN; PAM sequence: CTG
taacactcaccgcgaaggtc

SEQ ID NO: 14745 - DNA, 20 bp, Artificial Sequence
  Description of Artificial Sequence: Synthetic oligonucleotide
  Target: SOD1; (+) strand; PAM type: YTN; PAM sequence: CTC
accgcgaaggtctgcagctt

SEQ ID NO: 14746 - DNA, 20 bp, Artificial Sequence
  Description of Artificial Sequence: Synthetic oligonucleotide
  Target: SOD1; (+) strand; PAM type: YTN; PAM sequence: CTG
cagcttcactcctgagccag

SEQ ID NO: 14747 - DNA, 20 bp, Artificial Sequence
  Description of Artificial Sequence: Synthetic oligonucleotide
  Target: SOD1; (+) strand; PAM type: YTN; PAM sequence: CTT
cactcctgagccagcgagac

SEQ ID NO: 14748 - DNA, 20 bp, Artificial Sequence
  Description of Artificial Sequence: Synthetic oligonucleotide
  Target: SOD1; (+) strand; PAM type: YTN; PAM sequence: TTC
actcctgagccagcgagacc

SEQ ID NO: 14749 - DNA, 20 bp, Artificial Sequence
  Description of Artificial Sequence: Synthetic oligonucleotide
  Target: SOD1; (+) strand; PAM type: YTN; PAM sequence: CTC
ctgagccagcgagaccacaa

SEQ ID NO: 14750 - DNA, 20 bp, Artificial Sequence
  Description of Artificial Sequence: Synthetic oligonucleotide
  Target: SOD1; (+) strand; PAM type: YTN; PAM sequence: CTG
agccagcgagaccacaaacc

SEQ ID NO: 14751 - DNA, 20 bp, Artificial Sequence
  Description of Artificial Sequence: Synthetic oligonucleotide
  Target: SOD1; (+) strand; PAM type: YTN; PAM sequence: CTC
cgaacacatctgaacatcag

SEQ ID NO: 14752 - DNA, 20 bp, Artificial Sequence
  Description of Artificial Sequence: Synthetic oligonucleotide
  Target: SOD1; (+) strand; PAM type: YTN; PAM sequence: CTG
aacatcagaaggaacaaact

SEQ ID NO: 14753 - DNA, 20 bp, Artificial Sequence
  Description of Artificial Sequence: Synthetic oligonucleotide
  Target: SOD1; (+) strand; PAM type: YTN; PAM sequence: CTC
cggacacgccacctttaaga

SEQ ID NO: 14754 - DNA, 20 bp, Artificial Sequence
  Description of Artificial Sequence: Synthetic oligonucleotide
  Target: SOD1; (+) strand; PAM type: YTN; PAM sequence: CTT
taagaactgtaacactcacc

SEQ ID NO: 14755 - DNA, 20 bp, Artificial Sequence
  Description of Artificial Sequence: Synthetic oligonucleotide
  Target: SOD1; (+) strand; PAM type: YTN; PAM sequence: TTT
aagaactgtaacactcaccg

SEQ ID NO: 14756 - DNA, 20 bp, Artificial Sequence
  Description of Artificial Sequence: Synthetic oligonucleotide
  Target: SOD1; (+) strand; PAM type: YTN; PAM sequence: TTA
agaactgtaacactcaccgc

SEQ ID NO: 14757 - DNA, 20 bp, Artificial Sequence
  Description of Artificial Sequence: Synthetic oligonucleotide
  Target: SOD1; (+) strand; PAM type: YTN; PAM sequence: CTG
taacactcaccgcgagggtc

SEQ ID NO: 14758 - DNA, 20 bp, Artificial Sequence
  Description of Artificial Sequence: Synthetic oligonucleotide
  Target: SOD1; (+) strand; PAM type: YTN; PAM sequence: CTC
accgcgagggtccacggctt

SEQ ID NO: 14759 - DNA, 20 bp, Artificial Sequence
  Description of Artificial Sequence: Synthetic oligonucleotide
  Target: SOD1; (+) strand; PAM type: YTN; PAM sequence: CTT
cattcttgaagtcagtgaga

SEQ ID NO: 14760 - DNA, 20 bp, Artificial Sequence
  Description of Artificial Sequence: Synthetic oligonucleotide
  Target: SOD1; (+) strand; PAM type: YTN; PAM sequence: TTC
attcttgaagtcagtgagac

SEQ ID NO: 14761 - DNA, 20 bp, Artificial Sequence
  Description of Artificial Sequence: Synthetic oligonucleotide
  Target: SOD1; (+) strand; PAM type: YTN; PAM sequence: TTC
ttgaagtcagtgagaccaag

SEQ ID NO: 14762 - DNA, 20 bp, Artificial Sequence
  Description of Artificial Sequence: Synthetic oligonucleotide
  Target: SOD1; (+) strand; PAM type: YTN; PAM sequence: CTT
gaagtcagtgagaccaagaa

SEQ ID NO: 14763 - DNA, 20 bp, Artificial Sequence
  Description of Artificial Sequence: Synthetic oligonucleotide
  Target: SOD1; (+) strand; PAM type: YTN; PAM sequence: TTG
aagtcagtgagaccaagaac

SEQ ID NO: 14764 - DNA, 20 bp, Artificial Sequence
  Description of Artificial Sequence: Synthetic oligonucleotide
  Target: SOD1; (+) strand; PAM type: YTN; PAM sequence: TTC
cggacacaccagctactagg

SEQ ID NO: 14765 - DNA, 20 bp, Artificial Sequence
  Description of Artificial Sequence: Synthetic oligonucleotide
  Target: SOD1; (+) strand; PAM type: YTN; PAM sequence: CTA
ctagggaggctgaggtgagg

SEQ ID NO: 14766 - DNA, 20 bp, Artificial Sequence
  Description of Artificial Sequence: Synthetic oligonucleotide
  Target: SOD1; (+) strand; PAM type: YTN; PAM sequence: CTA
gggaggctgaggtgagggga

SEQ ID NO: 14767 - DNA, 20 bp, Artificial Sequence
  Description of Artificial Sequence: Synthetic oligonucleotide
  Target: SOD1; (+) strand; PAM type: YTN; PAM sequence: CTG
aggtgaggggatcacctgaa

SEQ ID NO: 14768 - DNA, 20 bp, Artificial Sequence
  Description of Artificial Sequence: Synthetic oligonucleotide
  Target: SOD1; (+) strand; PAM type: YTN; PAM sequence: CTG
aatccaggaagtcgagggtg

SEQ ID NO: 14769 - DNA, 20 bp, Artificial Sequence
  Description of Artificial Sequence: Synthetic oligonucleotide
  Target: SOD1; (+) strand; PAM type: YTN; PAM sequence: TTA
cactccagcctgagtgacag

SEQ ID NO: 14770 - DNA, 20 bp, Artificial Sequence
  Description of Artificial Sequence: Synthetic oligonucleotide
  Target: SOD1; (+) strand; PAM type: YTN; PAM sequence: CTC
cagcctgagtgacagagtga

SEQ ID NO: 14771 - DNA, 20 bp, Artificial Sequence
  Description of Artificial Sequence: Synthetic oligonucleotide
  Target: SOD1; (+) strand; PAM type: YTN; PAM sequence: CTG
agtgacagagtgagatcttg

SEQ ID NO: 14772 - DNA, 20 bp, Artificial Sequence
  Description of Artificial Sequence: Synthetic oligonucleotide
  Target: SOD1; (+) strand; PAM type: YTN; PAM sequence: CTT
gtgtcaaaaaaacagaacaa

SEQ ID NO: 14773 - DNA, 20 bp, Artificial Sequence
  Description of Artificial Sequence: Synthetic oligonucleotide
  Target: SOD1; (+) strand; PAM type: YTN; PAM sequence: TTG
tgtcaaaaaaacagaacaaa

SEQ ID NO: 14774 - DNA, 20 bp, Artificial Sequence
  Description of Artificial Sequence: Synthetic oligonucleotide
  Target: SOD1; (+) strand; PAM type: YTN; PAM sequence: TTG
aataggctgtgtgttaattc

SEQ ID NO: 14775 - DNA, 20 bp, Artificial Sequence
  Description of Artificial Sequence: Synthetic oligonucleotide
  Target: SOD1; (+) strand; PAM type: YTN; PAM sequence: CTG
tgtgttaattctgagatgga

SEQ ID NO: 14776 - DNA, 20 bp, Artificial Sequence
  Description of Artificial Sequence: Synthetic oligonucleotide
  Target: SOD1; (+) strand; PAM type: YTN; PAM sequence: TTA
attctgagatggagtccaga

SEQ ID NO: 14777 - DNA, 20 bp, Artificial Sequence
  Description of Artificial Sequence: Synthetic oligonucleotide
  Target: SOD1; (+) strand; PAM type: YTN; PAM sequence: TTC
tgagatggagtccagactta

SEQ ID NO: 14778 - DNA, 20 bp, Artificial Sequence
  Description of Artificial Sequence: Synthetic oligonucleotide
  Target: SOD1; (+) strand; PAM type: YTN; PAM sequence: CTG
agatggagtccagacttaag

SEQ ID NO: 14779 - DNA, 20 bp, Artificial Sequence
  Description of Artificial Sequence: Synthetic oligonucleotide
  Target: SOD1; (+) strand; PAM type: YTN; PAM sequence: CTT
aagaatgatcctgaggctta

SEQ ID NO: 14780 - DNA, 20 bp, Artificial Sequence
  Description of Artificial Sequence: Synthetic oligonucleotide
  Target: SOD1; (+) strand; PAM type: YTN; PAM sequence: TTA
agaatgatcctgaggcttag

SEQ ID NO: 14781 - DNA, 20 bp, Artificial Sequence
  Description of Artificial Sequence: Synthetic oligonucleotide
  Target: SOD1; (+) strand; PAM type: YTN; PAM sequence: CTG
aggcttagacccatatccaa

SEQ ID NO: 14782 - DNA, 20 bp, Artificial Sequence
  Description of Artificial Sequence: Synthetic oligonucleotide
  Target: SOD1; (+) strand; PAM type: YTN; PAM sequence: CTT
agacccatatccaagaggat

SEQ ID NO: 14783 - DNA, 20 bp, Artificial Sequence
  Description of Artificial Sequence: Synthetic oligonucleotide
  Target: SOD1; (+) strand; PAM type: YTN; PAM sequence: TTA
gacccatatccaagaggatg

SEQ ID NO: 14784 - DNA, 20 bp, Artificial Sequence
  Description of Artificial Sequence: Synthetic oligonucleotide
  Target: SOD1; (+) strand; PAM type: YTN; PAM sequence: TTC
cagcctggcacttataggtt

SEQ ID NO: 14785 - DNA, 20 bp, Artificial Sequence
  Description of Artificial Sequence: Synthetic oligonucleotide
  Target: SOD1; (+) strand; PAM type: YTN; PAM sequence: CTG
gcacttataggttcttcagg

SEQ ID NO: 14786 - DNA, 20 bp, Artificial Sequence
  Description of Artificial Sequence: Synthetic oligonucleotide
  Target: SOD1; (+) strand; PAM type: YTN; PAM sequence: CTT
ataggttcttcaggcacttc

SEQ ID NO: 14787 - DNA, 20 bp, Artificial Sequence
  Description of Artificial Sequence: Synthetic oligonucleotide
  Target: SOD1; (+) strand; PAM type: YTN; PAM sequence: TTA
taggttcttcaggcacttca

SEQ ID NO: 14788 - DNA, 20 bp, Artificial Sequence
  Description of Artificial Sequence: Synthetic oligonucleotide
  Target: SOD1; (+) strand; PAM type: YTN; PAM sequence: TTC
ttcaggcacttcagatgcac

SEQ ID NO: 14789 - DNA, 20 bp, Artificial Sequence
  Description of Artificial Sequence: Synthetic oligonucleotide
  Target: SOD1; (+) strand; PAM type: YTN; PAM sequence: CTT
caggcacttcagatgcaccc

SEQ ID NO: 14790 - DNA, 20 bp, Artificial Sequence
  Description of Artificial Sequence: Synthetic oligonucleotide
  Target: SOD1; (+) strand; PAM type: YTN; PAM sequence: TTC
aggcacttcagatgcaccct

SEQ ID NO: 14791 - DNA, 20 bp, Artificial Sequence
  Description of Artificial Sequence: Synthetic oligonucleotide
  Target: SOD1; (+) strand; PAM type: YTN; PAM sequence: CTT
cagatgcaccctgtcctgaa

SEQ ID NO: 14792 - DNA, 20 bp, Artificial Sequence
  Description of Artificial Sequence: Synthetic oligonucleotide
  Target: SOD1; (+) strand; PAM type: YTN; PAM sequence: TTC
agatgcaccctgtcctgaat

SEQ ID NO: 14793 - DNA, 20 bp, Artificial Sequence
  Description of Artificial Sequence: Synthetic oligonucleotide
  Target: SOD1; (+) strand; PAM type: YTN; PAM sequence: CTG
tcctgaattaagccctttgt

SEQ ID NO: 14794 - DNA, 20 bp, Artificial Sequence
  Description of Artificial Sequence: Synthetic oligonucleotide
  Target: SOD1; (+) strand; PAM type: YTN; PAM sequence: CTG
aattaagccctttgtccttg

SEQ ID NO: 14795 - DNA, 20 bp, Artificial Sequence
  Description of Artificial Sequence: Synthetic oligonucleotide
  Target: SOD1; (+) strand; PAM type: YTN; PAM sequence: TTA
agccctttgtccttgaacct

SEQ ID NO: 14796 - DNA, 20 bp, Artificial Sequence
  Description of Artificial Sequence: Synthetic oligonucleotide
  Target: SOD1; (+) strand; PAM type: YTN; PAM sequence: CTT
tgtccttgaacctgctttcc

SEQ ID NO: 14797 - DNA, 20 bp, Artificial Sequence
  Description of Artificial Sequence: Synthetic oligonucleotide
  Target: SOD1; (+) strand; PAM type: YTN; PAM sequence: TTT
gtccttgaacctgctttcct

SEQ ID NO: 14798 - DNA, 20 bp, Artificial Sequence
  Description of Artificial Sequence: Synthetic oligonucleotide
  Target: SOD1; (+) strand; PAM type: YTN; PAM sequence: TTG
tccttgaacctgctttcctt

SEQ ID NO: 14799 - DNA, 20 bp, Artificial Sequence
  Description of Artificial Sequence: Synthetic oligonucleotide
  Target: SOD1; (+) strand; PAM type: YTN; PAM sequence: CTT
gaacctgctttccttggtaa

SEQ ID NO: 14800 - DNA, 20 bp, Artificial Sequence
  Description of Artificial Sequence: Synthetic oligonucleotide
  Target: SOD1; (+) strand; PAM type: YTN; PAM sequence: TTG
aacctgctttccttggtaaa

SEQ ID NO: 14801 - DNA, 20 bp, Artificial Sequence
  Description of Artificial Sequence: Synthetic oligonucleotide
  Target: SOD1; (+) strand; PAM type: YTN; PAM sequence: CTG
ctttccttggtaaacagcac

SEQ ID NO: 14802 - DNA, 20 bp, Artificial Sequence
  Description of Artificial Sequence: Synthetic oligonucleotide
  Target: SOD1; (+) strand; PAM type: YTN; PAM sequence: CTT
tccttggtaaacagcaccaa

SEQ ID NO: 14803 - DNA, 20 bp, Artificial Sequence
  Description of Artificial Sequence: Synthetic oligonucleotide
  Target: SOD1; (+) strand; PAM type: YTN; PAM sequence: TTT
ccttggtaaacagcaccaag

SEQ ID NO: 14804 - DNA, 20 bp, Artificial Sequence
  Description of Artificial Sequence: Synthetic oligonucleotide
  Target: SOD1; (+) strand; PAM type: YTN; PAM sequence: TTC
cttggtaaacagcaccaagg

SEQ ID NO: 14805 - DNA, 20 bp, Artificial Sequence
  Description of Artificial Sequence: Synthetic oligonucleotide
  Target: SOD1; (+) strand; PAM type: YTN; PAM sequence: CTT
ggtaaacagcaccaaggggg

SEQ ID NO: 14806 - DNA, 20 bp, Artificial Sequence
  Description of Artificial Sequence: Synthetic oligonucleotide
  Target: SOD1; (+) strand; PAM type: YTN; PAM sequence: TTG
gtaaacagcaccaagggggc

SEQ ID NO: 14807 - DNA, 20 bp, Artificial Sequence
  Description of Artificial Sequence: Synthetic oligonucleotide
  Target: SOD1; (+) strand; PAM type: YTN; PAM sequence: CTA
gaaacctgggggctgccctt

SEQ ID NO: 14808 - DNA, 20 bp, Artificial Sequence
  Description of Artificial Sequence: Synthetic oligonucleotide
  Target: SOD1; (+) strand; PAM type: YTN; PAM sequence: CTG
ggggctgcccttaccttccc

SEQ ID NO: 14809 - DNA, 20 bp, Artificial Sequence
  Description of Artificial Sequence: Synthetic oligonucleotide
  Target: SOD1; (+) strand; PAM type: YTN; PAM sequence: CTG
cccttaccttccctctctca

SEQ ID NO: 14810 - DNA, 20 bp, Artificial Sequence
  Description of Artificial Sequence: Synthetic oligonucleotide
  Target: SOD1; (+) strand; PAM type: YTN; PAM sequence: CTT
accttccctctctcaccatg

SEQ ID NO: 14811 - DNA, 20 bp, Artificial Sequence
  Description of Artificial Sequence: Synthetic oligonucleotide
  Target: SOD1; (+) strand; PAM type: YTN; PAM sequence: TTA
ccttccctctctcaccatgc

SEQ ID NO: 14812 - DNA, 20 bp, Artificial Sequence
  Description of Artificial Sequence: Synthetic oligonucleotide
  Target: SOD1; (+) strand; PAM type: YTN; PAM sequence: CTT
ccctctctcaccatgcacct

SEQ ID NO: 14813 - DNA, 20 bp, Artificial Sequence
  Description of Artificial Sequence: Synthetic oligonucleotide
  Target: SOD1; (+) strand; PAM type: YTN; PAM sequence: TTC
cctctctcaccatgcacctc

SEQ ID NO: 14814 - DNA, 20 bp, Artificial Sequence
  Description of Artificial Sequence: Synthetic oligonucleotide
  Target: SOD1; (+) strand; PAM type: YTN; PAM sequence: CTC
tctcaccatgcacctctaat

SEQ ID NO: 14815 - DNA, 20 bp, Artificial Sequence
  Description of Artificial Sequence: Synthetic oligonucleotide
  Target: SOD1; (+) strand; PAM type: YTN; PAM sequence: CTC
tcaccatgcacctctaatgg

SEQ ID NO: 14816 - DNA, 20 bp, Artificial Sequence
  Description of Artificial Sequence: Synthetic oligonucleotide
  Target: SOD1; (+) strand; PAM type: YTN; PAM sequence: CTC
accatgcacctctaatgggt

SEQ ID NO: 14817 - DNA, 20 bp, Artificial Sequence
  Description of Artificial Sequence: Synthetic oligonucleotide
  Target: SOD1; (+) strand; PAM type: YTN; PAM sequence: CTC
taatgggtggctggacttgt

SEQ ID NO: 14818 - DNA, 20 bp, Artificial Sequence
  Description of Artificial Sequence: Synthetic oligonucleotide
  Target: SOD1; (+) strand; PAM type: YTN; PAM sequence: CTA
atgggtggctggacttgtgg

SEQ ID NO: 14819 - DNA, 20 bp, Artificial Sequence
  Description of Artificial Sequence: Synthetic oligonucleotide
  Target: SOD1; (+) strand; PAM type: YTN; PAM sequence: CTG
gacttgtggttgcatttccg

SEQ ID NO: 14820 - DNA, 20 bp, Artificial Sequence
  Description of Artificial Sequence: Synthetic oligonucleotide
  Target: SOD1; (+) strand; PAM type: YTN; PAM sequence: CTT
gtggttgcatttccgtgatc

SEQ ID NO: 14821 - DNA, 20 bp, Artificial Sequence
  Description of Artificial Sequence: Synthetic oligonucleotide
  Target: SOD1; (+) strand; PAM type: YTN; PAM sequence: TTG
tggttgcatttccgtgatct

SEQ ID NO: 14822 - DNA, 20 bp, Artificial Sequence
  Description of Artificial Sequence: Synthetic oligonucleotide
  Target: SOD1; (+) strand; PAM type: YTN; PAM sequence: TTG
catttccgtgatctcccagc

SEQ ID NO: 14823 - DNA, 20 bp, Artificial Sequence
  Description of Artificial Sequence: Synthetic oligonucleotide
  Target: SOD1; (+) strand; PAM type: YTN; PAM sequence: TTT
ccgtgatctcccagctttct

SEQ ID NO: 14824 - DNA, 20 bp, Artificial Sequence
  Description of Artificial Sequence: Synthetic oligonucleotide
  Target: SOD1; (+) strand; PAM type: YTN; PAM sequence: TTC
cgtgatctcccagctttctt

SEQ ID NO: 14825 - DNA, 20 bp, Artificial Sequence
  Description of Artificial Sequence: Synthetic oligonucleotide
  Target: SOD1; (+) strand; PAM type: YTN; PAM sequence: CTC
ccagctttcttccagtgatg

SEQ ID NO: 14826 - DNA, 20 bp, Artificial Sequence
  Description of Artificial Sequence: Synthetic oligonucleotide
  Target: SOD1; (+) strand; PAM type: YTN; PAM sequence: CTT
tcttccagtgatggccttag

SEQ ID NO: 14827 - DNA, 20 bp, Artificial Sequence
  Description of Artificial Sequence: Synthetic oligonucleotide
  Target: SOD1; (+) strand; PAM type: YTN; PAM sequence: TTT
cttccagtgatggccttagg

SEQ ID NO: 14828 - DNA, 20 bp, Artificial Sequence
  Description of Artificial Sequence: Synthetic oligonucleotide
  Target: SOD1; (+) strand; PAM type: YTN; PAM sequence: TTC
ttccagtgatggccttaggt

SEQ ID NO: 14829 - DNA, 20 bp, Artificial Sequence
  Description of Artificial Sequence: Synthetic oligonucleotide
  Target: SOD1; (+) strand; PAM type: YTN; PAM sequence: CTT
ccagtgatggccttaggtgg

SEQ ID NO: 14830 - DNA, 20 bp, Artificial Sequence
  Description of Artificial Sequence: Synthetic oligonucleotide
  Target: SOD1; (+) strand; PAM type: YTN; PAM sequence: TTC
cagtgatggccttaggtggg

SEQ ID NO: 14831 - DNA, 20 bp, Artificial Sequence
  Description of Artificial Sequence: Synthetic oligonucleotide
  Target: SOD1; (+) strand; PAM type: YTN; PAM sequence: CTT
aggtgggctcttatcctgtc

SEQ ID NO: 14832 - DNA, 20 bp, Artificial Sequence
  Description of Artificial Sequence: Synthetic oligonucleotide
  Target: SOD1; (+) strand; PAM type: YTN; PAM sequence: TTA
ggtgggctcttatcctgtct

SEQ ID NO: 14833 - DNA, 20 bp, Artificial Sequence
  Description of Artificial Sequence: Synthetic oligonucleotide
  Target: SOD1; (+) strand; PAM type: YTN; PAM sequence: CTC
ttatcctgtctcccaaatgg

SEQ ID NO: 14834 - DNA, 20 bp, Artificial Sequence
  Description of Artificial Sequence: Synthetic oligonucleotide
  Target: SOD1; (+) strand; PAM type: YTN; PAM sequence: CTT
atcctgtctcccaaatggcc

SEQ ID NO: 14835 - DNA, 20 bp, Artificial Sequence
  Description of Artificial Sequence: Synthetic oligonucleotide
  Target: SOD1; (+) strand; PAM type: YTN; PAM sequence: TTA
tcctgtctcccaaatggcct

SEQ ID NO: 14836 - DNA, 20 bp, Artificial Sequence
  Description of Artificial Sequence: Synthetic oligonucleotide
  Target: SOD1; (+) strand; PAM type: YTN; PAM sequence: CTG
tctcccaaatggcctctctg

SEQ ID NO: 14837 - DNA, 20 bp, Artificial Sequence
  Description of Artificial Sequence: Synthetic oligonucleotide
  Target: SOD1; (+) strand; PAM type: YTN; PAM sequence: CTC
ccaaatggcctctctgcctt

SEQ ID NO: 14838 - DNA, 20 bp, Artificial Sequence
  Description of Artificial Sequence: Synthetic oligonucleotide
  Target: SOD1; (+) strand; PAM type: YTN; PAM sequence: CTC
tctgccttgagtctcacccc

SEQ ID NO: 14839 - DNA, 20 bp, Artificial Sequence
  Description of Artificial Sequence: Synthetic oligonucleotide
  Target: SOD1; (+) strand; PAM type: YTN; PAM sequence: CTC
tgccttgagtctcaccccat

SEQ ID NO: 14840 - DNA, 20 bp, Artificial Sequence
  Description of Artificial Sequence: Synthetic oligonucleotide
  Target: SOD1; (+) strand; PAM type: YTN; PAM sequence: CTG
ccttgagtctcaccccatct

SEQ ID NO: 14841 - DNA, 20 bp, Artificial Sequence
  Description of Artificial Sequence: Synthetic oligonucleotide
  Target: SOD1; (+) strand; PAM type: YTN; PAM sequence: CTT
gagtctcaccccatctgctc

SEQ ID NO: 14842 - DNA, 20 bp, Artificial Sequence
  Description of Artificial Sequence: Synthetic oligonucleotide
  Target: SOD1; (+) strand; PAM type: YTN; PAM sequence: TTG
agtctcaccccatctgctct

SEQ ID NO: 14843 - DNA, 20 bp, Artificial Sequence
  Description of Artificial Sequence: Synthetic oligonucleotide
  Target: SOD1; (+) strand; PAM type: YTN; PAM sequence: CTC
accccatctgctctcagtcc

SEQ ID NO: 14844 - DNA, 20 bp, Artificial Sequence
  Description of Artificial Sequence: Synthetic oligonucleotide
  Target: SOD1; (+) strand; PAM type: YTN; PAM sequence: CTG
ctctcagtccacccactgag

SEQ ID NO: 14845 - DNA, 20 bp, Artificial Sequence
  Description of Artificial Sequence: Synthetic oligonucleotide
  Target: SOD1; (+) strand; PAM type: YTN; PAM sequence: CTC
tcagtccacccactgagcta

SEQ ID NO: 14846 - DNA, 20 bp, Artificial Sequence
  Description of Artificial Sequence: Synthetic oligonucleotide
  Target: SOD1; (+) strand; PAM type: YTN; PAM sequence: CTC
agtccacccactgagctatt

SEQ ID NO: 14847 - DNA, 20 bp, Artificial Sequence
  Description of Artificial Sequence: Synthetic oligonucleotide
  Target: SOD1; (+) strand; PAM type: YTN; PAM sequence: CTG
agctattccagagaccattc

SEQ ID NO: 14848 - DNA, 20 bp, Artificial Sequence
  Description of Artificial Sequence: Synthetic oligonucleotide
  Target: SOD1; (+) strand; PAM type: YTN; PAM sequence: CTA
ttccagagaccattctgact

SEQ ID NO: 14849 - DNA, 20 bp, Artificial Sequence
  Description of Artificial Sequence: Synthetic oligonucleotide
  Target: SOD1; (+) strand; PAM type: YTN; PAM sequence: TTC
cagagaccattctgactccc

SEQ ID NO: 14850 - DNA, 20 bp, Artificial Sequence
  Description of Artificial Sequence: Synthetic oligonucleotide
  Target: SOD1; (+) strand; PAM type: YTN; PAM sequence: TTC
tgactccctgtggacacccc

SEQ ID NO: 14851 - DNA, 20 bp, Artificial Sequence
  Description of Artificial Sequence: Synthetic oligonucleotide
  Target: SOD1; (+) strand; PAM type: YTN; PAM sequence: CTG
actccctgtggacacccctc

SEQ ID NO: 14852 - DNA, 20 bp, Artificial Sequence
  Description of Artificial Sequence: Synthetic oligonucleotide
  Target: SOD1; (+) strand; PAM type: YTN; PAM sequence: CTC
cctgtggacacccctctggt

SEQ ID NO: 14853 - DNA, 20 bp, Artificial Sequence
  Description of Artificial Sequence: Synthetic oligonucleotide
  Target: SOD1; (+) strand; PAM type: YTN; PAM sequence: CTG
tggacacccctctggtggct

SEQ ID NO: 14854 - DNA, 20 bp, Artificial Sequence
  Description of Artificial Sequence: Synthetic oligonucleotide
  Target: SOD1; (+) strand; PAM type: YTN; PAM sequence: CTC
tggtggcttctcctctctgt

SEQ ID NO: 14855 - DNA, 20 bp, Artificial Sequence
  Description of Artificial Sequence: Synthetic oligonucleotide
  Target: SOD1; (+) strand; PAM type: YTN; PAM sequence: CTG
gtggcttctcctctctgtca

SEQ ID NO: 14856 - DNA, 20 bp, Artificial Sequence
  Description of Artificial Sequence: Synthetic oligonucleotide
  Target: SOD1; (+) strand; PAM type: YTN; PAM sequence: CTT
ctcctctctgtcagttagaa

SEQ ID NO: 14857 - DNA, 20 bp, Artificial Sequence
  Description of Artificial Sequence: Synthetic oligonucleotide
  Target: SOD1; (+) strand; PAM type: YTN; PAM sequence: TTC
tcctctctgtcagttagaaa

SEQ ID NO: 14858 - DNA, 20 bp, Artificial Sequence
  Description of Artificial Sequence: Synthetic oligonucleotide
  Target: SOD1; (+) strand; PAM type: YTN; PAM sequence: CTC
ctctctgtcagttagaaatt

SEQ ID NO: 14859 - DNA, 20 bp, Artificial Sequence
  Description of Artificial Sequence: Synthetic oligonucleotide
  Target: SOD1; (+) strand; PAM type: YTN; PAM sequence: CTC
tctgtcagttagaaattgct

SEQ ID NO: 14860 - DNA, 20 bp, Artificial Sequence
  Description of Artificial Sequence: Synthetic oligonucleotide
  Target: SOD1; (+) strand; PAM type: YTN; PAM sequence: CTC
tgtcagttagaaattgcttt

SEQ ID NO: 14861 - DNA, 20 bp, Artificial Sequence
  Description of Artificial Sequence: Synthetic oligonucleotide
  Target: SOD1; (+) strand; PAM type: YTN; PAM sequence: CTG
tcagttagaaattgcttttg

SEQ ID NO: 14862 - DNA, 20 bp, Artificial Sequence
  Description of Artificial Sequence: Synthetic oligonucleotide
  Target: SOD1; (+) strand; PAM type: YTN; PAM sequence: TTA
gaaattgcttttgactgcat

SEQ ID NO: 14863 - DNA, 20 bp, Artificial Sequence
  Description of Artificial Sequence: Synthetic oligonucleotide
  Target: SOD1; (+) strand; PAM type: YTN; PAM sequence: TTG
cttttgactgcatgtaacaa

SEQ ID NO: 14864 - DNA, 20 bp, Artificial Sequence
  Description of Artificial Sequence: Synthetic oligonucleotide
  Target: SOD1; (+) strand; PAM type: YTN; PAM sequence: CTT
ttgactgcatgtaacaaatg

SEQ ID NO: 14865 - DNA, 20 bp, Artificial Sequence
  Description of Artificial Sequence: Synthetic oligonucleotide
  Target: SOD1; (+) strand; PAM type: YTN; PAM sequence: TTT
tgactgcatgtaacaaatgt

SEQ ID NO: 14866 - DNA, 20 bp, Artificial Sequence
  Description of Artificial Sequence: Synthetic oligonucleotide
  Target: SOD1; (+) strand; PAM type: YTN; PAM sequence: TTT
gactgcatgtaacaaatgtg

SEQ ID NO: 14867 - DNA, 20 bp, Artificial Sequence
  Description of Artificial Sequence: Synthetic oligonucleotide
  Target: SOD1; (+) strand; PAM type: YTN; PAM sequence: TTG
actgcatgtaacaaatgtgg

SEQ ID NO: 14868 - DNA, 20 bp, Artificial Sequence
  Description of Artificial Sequence: Synthetic oligonucleotide
  Target: SOD1; (+) strand; PAM type: YTN; PAM sequence: CTG
catgtaacaaatgtggttac

SEQ ID NO: 14869 - DNA, 20 bp, Artificial Sequence
  Description of Artificial Sequence: Synthetic oligonucleotide
  Target: SOD1; (+) strand; PAM type: YTN; PAM sequence: TTA
cgctatttaaccaaataaag

SEQ ID NO: 14870 - DNA, 20 bp, Artificial Sequence
  Description of Artificial Sequence: Synthetic oligonucleotide
  Target: SOD1; (+) strand; PAM type: YTN; PAM sequence: CTA
tttaaccaaataaaggttta

SEQ ID NO: 14871 - DNA, 20 bp, Artificial Sequence
  Description of Artificial Sequence: Synthetic oligonucleotide
  Target: SOD1; (+) strand; PAM type: YTN; PAM sequence: TTT
aaccaaataaaggtttattt

SEQ ID NO: 14872 - DNA, 20 bp, Artificial Sequence
  Description of Artificial Sequence: Synthetic oligonucleotide
  Target: SOD1; (+) strand; PAM type: YTN; PAM sequence: TTA
accaaataaaggtttatttt

SEQ ID NO: 14873 - DNA, 20 bp, Artificial Sequence
  Description of Artificial Sequence: Synthetic oligonucleotide
  Target: SOD1; (+) strand; PAM type: YTN; PAM sequence: TTT
atttttctcgtgatgaaaag

SEQ ID NO: 14874 - DNA, 20 bp, Artificial Sequence
  Description of Artificial Sequence: Synthetic oligonucleotide
  Target: SOD1; (+) strand; PAM type: YTN; PAM sequence: TTA
tttttctcgtgatgaaaagt

SEQ ID NO: 14875 - DNA, 20 bp, Artificial Sequence
  Description of Artificial Sequence: Synthetic oligonucleotide
  Target: SOD1; (+) strand; PAM type: YTN; PAM sequence: TTT
ttctcgtgatgaaaagtaca

SEQ ID NO: 14876 - DNA, 20 bp, Artificial Sequence
  Description of Artificial Sequence: Synthetic oligonucleotide
  Target: SOD1; (+) strand; PAM type: YTN; PAM sequence: TTT
tctcgtgatgaaaagtacac

SEQ ID NO: 14877 - DNA, 20 bp, Artificial Sequence
  Description of Artificial Sequence: Synthetic oligonucleotide
  Target: SOD1; (+) strand; PAM type: YTN; PAM sequence: TTT
ctcgtgatgaaaagtacaca

SEQ ID NO: 14878 - DNA, 20 bp, Artificial Sequence
  Description of Artificial Sequence: Synthetic oligonucleotide
  Target: SOD1; (+) strand; PAM type: YTN; PAM sequence: TTC
tcgtgatgaaaagtacacag

SEQ ID NO: 14879 - DNA, 20 bp, Artificial Sequence
  Description of Artificial Sequence: Synthetic oligonucleotide
  Target: SOD1; (+) strand; PAM type: YTN; PAM sequence: CTC
gtgatgaaaagtacacagat

SEQ ID NO: 14880 - DNA, 20 bp, Artificial Sequence
  Description of Artificial Sequence: Synthetic oligonucleotide
  Target: SOD1; (+) strand; PAM type: YTN; PAM sequence: CTA
cttccatcgataaccattga

SEQ ID NO: 14881 - DNA, 20 bp, Artificial Sequence
  Description of Artificial Sequence: Synthetic oligonucleotide
  Target: SOD1; (+) strand; PAM type: YTN; PAM sequence: CTT
ccatcgataaccattgaggg

SEQ ID NO: 14882 - DNA, 20 bp, Artificial Sequence
  Description of Artificial Sequence: Synthetic oligonucleotide
  Target: SOD1; (+) strand; PAM type: YTN; PAM sequence: TTC
catcgataaccattgagggt

SEQ ID NO: 14883 - DNA, 20 bp, Artificial Sequence
  Description of Artificial Sequence: Synthetic oligonucleotide
  Target: SOD1; (+) strand; PAM type: YTN; PAM sequence: TTG
agggtttcttatgactctta

SEQ ID NO: 14884 - DNA, 20 bp, Artificial Sequence
  Description of Artificial Sequence: Synthetic oligonucleotide
  Target: SOD1; (+) strand; PAM type: YTN; PAM sequence: TTT
cttatgactcttacagcaat

SEQ ID NO: 14885 - DNA, 20 bp, Artificial Sequence
  Description of Artificial Sequence: Synthetic oligonucleotide
  Target: SOD1; (+) strand; PAM type: YTN; PAM sequence: TTC
ttatgactcttacagcaatg

SEQ ID NO: 14886 - DNA, 20 bp, Artificial Sequence
  Description of Artificial Sequence: Synthetic oligonucleotide
  Target: SOD1; (+) strand; PAM type: YTN; PAM sequence: CTT
atgactcttacagcaatgaa

SEQ ID NO: 14887 - DNA, 20 bp, Artificial Sequence
  Description of Artificial Sequence: Synthetic oligonucleotide
  Target: SOD1; (+) strand; PAM type: YTN; PAM sequence: TTA
tgactcttacagcaatgaaa

SEQ ID NO: 14888 - DNA, 20 bp, Artificial Sequence
  Description of Artificial Sequence: Synthetic oligonucleotide
  Target: SOD1; (+) strand; PAM type: YTN; PAM sequence: CTC
ttacagcaatgaaatgtgta

SEQ ID NO: 14889 - DNA, 20 bp, Artificial Sequence
  Description of Artificial Sequence: Synthetic oligonucleotide
  Target: SOD1; (+) strand; PAM type: YTN; PAM sequence: CTT
acagcaatgaaatgtgtatt

SEQ ID NO: 14890 - DNA, 20 bp, Artificial Sequence
  Description of Artificial Sequence: Synthetic oligonucleotide
  Target: SOD1; (+) strand; PAM type: YTN; PAM sequence: TTA
cagcaatgaaatgtgtattt

SEQ ID NO: 14891 - DNA, 20 bp, Artificial Sequence
  Description of Artificial Sequence: Synthetic oligonucleotide
  Target: SOD1; (+) strand; PAM type: YTN; PAM sequence: TTT
acagtataaagatatacaat

SEQ ID NO: 14892 - DNA, 20 bp, Artificial Sequence
  Description of Artificial Sequence: Synthetic oligonucleotide
  Target: SOD1; (+) strand; PAM type: YTN; PAM sequence: TTA
cagtataaagatatacaatt

SEQ ID NO: 14893 - DNA, 20 bp, Artificial Sequence
  Description of Artificial Sequence: Synthetic oligonucleotide
  Target: SOD1; (+) strand; PAM type: YTN; PAM sequence: TTT
taaggttttaatataattgg

SEQ ID NO: 14894 - DNA, 20 bp, Artificial Sequence
  Description of Artificial Sequence: Synthetic oligonucleotide
  Target: SOD1; (+) strand; PAM type: YTN; PAM sequence: TTT
aaggttttaatataattggg

SEQ ID NO: 14895 - DNA, 20 bp, Artificial Sequence
  Description of Artificial Sequence: Synthetic oligonucleotide
  Target: SOD1; (+) strand; PAM type: YTN; PAM sequence: TTA
aggttttaatataattgggc

SEQ ID NO: 14896 - DNA, 20 bp, Artificial Sequence
  Description of Artificial Sequence: Synthetic oligonucleotide
  Target: SOD1; (+) strand; PAM type: YTN; PAM sequence: TTT
taatataattgggcctaagc

SEQ ID NO: 14897 - DNA, 20 bp, Artificial Sequence
  Description of Artificial Sequence: Synthetic oligonucleotide
  Target: SOD1; (+) strand; PAM type: YTN; PAM sequence: TTT
aatataattgggcctaagca

SEQ ID NO: 14898 - DNA, 20 bp, Artificial Sequence
  Description of Artificial Sequence: Synthetic oligonucleotide
  Target: SOD1; (+) strand; PAM type: YTN; PAM sequence: TTA
atataattgggcctaagcac

SEQ ID NO: 14899 - DNA, 20 bp, Artificial Sequence
  Description of Artificial Sequence: Synthetic oligonucleotide
  Target: SOD1; (+) strand; PAM type: YTN; PAM sequence: TTG
ggcctaagcacagtattttt

SEQ ID NO: 14900 - DNA, 20 bp, Artificial Sequence
  Description of Artificial Sequence: Synthetic oligonucleotide
  Target: SOD1; (+) strand; PAM type: YTN; PAM sequence: CTA
agcacagtattttttgtttt

SEQ ID NO: 14901 - DNA, 20 bp, Artificial Sequence
  Description of Artificial Sequence: Synthetic oligonucleotide
  Target: SOD1; (+) strand; PAM type: YTN; PAM sequence: TTT
tttgttttagttttcaactg

SEQ ID NO: 14902 - DNA, 20 bp, Artificial Sequence
  Description of Artificial Sequence: Synthetic oligonucleotide
  Target: SOD1; (+) strand; PAM type: YTN; PAM sequence: TTT
ttgttttagttttcaactgc

SEQ ID NO: 14903 - DNA, 20 bp, Artificial Sequence
  Description of Artificial Sequence: Synthetic oligonucleotide
  Target: SOD1; (+) strand; PAM type: YTN; PAM sequence: TTT
tgttttagttttcaactgcc

SEQ ID NO: 14904 - DNA, 20 bp, Artificial Sequence
  Description of Artificial Sequence: Synthetic oligonucleotide
  Target: SOD1; (+) strand; PAM type: YTN; PAM sequence: TTT
gttttagttttcaactgccc

SEQ ID NO: 14905 - DNA, 20 bp, Artificial Sequence
  Description of Artificial Sequence: Synthetic oligonucleotide
  Target: SOD1; (+) strand; PAM type: YTN; PAM sequence: TTG
ttttagttttcaactgccca

SEQ ID NO: 14906 - DNA, 20 bp, Artificial Sequence
  Description of Artificial Sequence: Synthetic oligonucleotide
  Target: SOD1; (+) strand; PAM type: YTN; PAM sequence: TTT
tagttttcaactgcccaggt

SEQ ID NO: 14907 - DNA, 20 bp, Artificial Sequence
  Description of Artificial Sequence: Synthetic oligonucleotide
  Target: SOD1; (+) strand; PAM type: YTN; PAM sequence: TTT
agttttcaactgcccaggtg

SEQ ID NO: 14908 - DNA, 20 bp, Artificial Sequence
  Description of Artificial Sequence: Synthetic oligonucleotide
  Target: SOD1; (+) strand; PAM type: YTN; PAM sequence: TTA
gttttcaactgcccaggtga

SEQ ID NO: 14909 - DNA, 20 bp, Artificial Sequence
  Description of Artificial Sequence: Synthetic oligonucleotide
  Target: SOD1; (+) strand; PAM type: YTN; PAM sequence: TTT
tcaactgcccaggtgattct

SEQ ID NO: 14910 - DNA, 20 bp, Artificial Sequence
  Description of Artificial Sequence: Synthetic oligonucleotide
  Target: SOD1; (+) strand; PAM type: YTN; PAM sequence: TTT
caactgcccaggtgattcta

SEQ ID NO: 14911 - DNA, 20 bp, Artificial Sequence
  Description of Artificial Sequence: Synthetic oligonucleotide
  Target: SOD1; (+) strand; PAM type: YTN; PAM sequence: TTC
aactgcccaggtgattctat

SEQ ID NO: 14912 - DNA, 20 bp, Artificial Sequence
  Description of Artificial Sequence: Synthetic oligonucleotide
  Target: SOD1; (+) strand; PAM type: YTN; PAM sequence: CTG
cccaggtgattctattgtgc

SEQ ID NO: 14913 - DNA, 20 bp, Artificial Sequence
  Description of Artificial Sequence: Synthetic oligonucleotide
  Target: SOD1; (+) strand; PAM type: YTN; PAM sequence: TTC
tattgtgcagccagggttga

SEQ ID NO: 14914 - DNA, 20 bp, Artificial Sequence
  Description of Artificial Sequence: Synthetic oligonucleotide
  Target: SOD1; (+) strand; PAM type: YTN; PAM sequence: CTA
ttgtgcagccagggttgata

SEQ ID NO: 14915 - DNA, 20 bp, Artificial Sequence
  Description of Artificial Sequence: Synthetic oligonucleotide
  Target: SOD1; (+) strand; PAM type: YTN; PAM sequence: TTG
tgcagccagggttgataaac

SEQ ID NO: 14916 - DNA, 20 bp, Artificial Sequence
  Description of Artificial Sequence: Synthetic oligonucleotide
  Target: SOD1; (+) strand; PAM type: YTN; PAM sequence: TTG
ataaacactgcatctaggcc

SEQ ID NO: 14917 - DNA, 20 bp, Artificial Sequence
  Description of Artificial Sequence: Synthetic oligonucleotide
  Target: SOD1; (+) strand; PAM type: YTN; PAM sequence: CTG
catctaggcccagtgccttt

SEQ ID NO: 14918 - DNA, 20 bp, Artificial Sequence
  Description of Artificial Sequence: Synthetic oligonucleotide
  Target: SOD1; (+) strand; PAM type: YTN; PAM sequence: CTA
ggcccagtgcctttgatttg

SEQ ID NO: 14919 - DNA, 20 bp, Artificial Sequence
  Description of Artificial Sequence: Synthetic oligonucleotide
  Target: SOD1; (+) strand; PAM type: YTN; PAM sequence: CTT
tgatttgcagctgaggtcta

SEQ ID NO: 14920 - DNA, 20 bp, Artificial Sequence
  Description of Artificial Sequence: Synthetic oligonucleotide
  Target: SOD1; (+) strand; PAM type: YTN; PAM sequence: TTT
gatttgcagctgaggtctag

SEQ ID NO: 14921 - DNA, 20 bp, Artificial Sequence
  Description of Artificial Sequence: Synthetic oligonucleotide
  Target: SOD1; (+) strand; PAM type: YTN; PAM sequence: TTG
atttgcagctgaggtctaga

SEQ ID NO: 14922 - DNA, 20 bp, Artificial Sequence
  Description of Artificial Sequence: Synthetic oligonucleotide
  Target: SOD1; (+) strand; PAM type: YTN; PAM sequence: TTT
gcagctgaggtctagagaga

SEQ ID NO: 14923 - DNA, 20 bp, Artificial Sequence
  Description of Artificial Sequence: Synthetic oligonucleotide
  Target: SOD1; (+) strand; PAM type: YTN; PAM sequence: TTG
cagctgaggtctagagagaa

SEQ ID NO: 14924 - DNA, 20 bp, Artificial Sequence
  Description of Artificial Sequence: Synthetic oligonucleotide
  Target: SOD1; (+) strand; PAM type: YTN; PAM sequence: CTG
aggtctagagagaattattg

SEQ ID NO: 14925 - DNA, 20 bp, Artificial Sequence
  Description of Artificial Sequence: Synthetic oligonucleotide
  Target: SOD1; (+) strand; PAM type: YTN; PAM sequence: CTA
gagagaattattgaaactgc

SEQ ID NO: 14926 - DNA, 20 bp, Artificial Sequence
  Description of Artificial Sequence: Synthetic oligonucleotide
  Target: SOD1; (+) strand; PAM type: YTN; PAM sequence: TTA
ttgaaactgcagtcccagct

SEQ ID NO: 14927 - DNA, 20 bp, Artificial Sequence
  Description of Artificial Sequence: Synthetic oligonucleotide
  Target: SOD1; (+) strand; PAM type: YTN; PAM sequence: TTG
aaactgcagtcccagctact

SEQ ID NO: 14928 - DNA, 20 bp, Artificial Sequence
  Description of Artificial Sequence: Synthetic oligonucleotide
  Target: SOD1; (+) strand; PAM type: YTN; PAM sequence: CTG
cagtcccagctacttgggag

SEQ ID NO: 14929 - DNA, 20 bp, Artificial Sequence
  Description of Artificial Sequence: Synthetic oligonucleotide
  Target: SOD1; (+) strand; PAM type: YTN; PAM sequence: CTA
cttgggaggctgaggttgga

SEQ ID NO: 14930 - DNA, 20 bp, Artificial Sequence
  Description of Artificial Sequence: Synthetic oligonucleotide
  Target: SOD1; (+) strand; PAM type: YTN; PAM sequence: CTT
gggaggctgaggttggagaa

SEQ ID NO: 14931 - DNA, 20 bp, Artificial Sequence
  Description of Artificial Sequence: Synthetic oligonucleotide
  Target: SOD1; (+) strand; PAM type: YTN; PAM sequence: TTG
ggaggctgaggttggagaat

SEQ ID NO: 14932 - DNA, 20 bp, Artificial Sequence
  Description of Artificial Sequence: Synthetic oligonucleotide
  Target: SOD1; (+) strand; PAM type: YTN; PAM sequence: CTG
aggttggagaattgcctaag

SEQ ID NO: 14933 - DNA, 20 bp, Artificial Sequence
  Description of Artificial Sequence: Synthetic oligonucleotide
  Target: SOD1; (+) strand; PAM type: YTN; PAM sequence: TTG
gagaattgcctaagcccagc

SEQ ID NO: 14934 - DNA, 20 bp, Artificial Sequence
  Description of Artificial Sequence: Synthetic oligonucleotide
  Target: SOD1; (+) strand; PAM type: YTN; PAM sequence: TTG
cctaagcccagcggggtgag

SEQ ID NO: 14935 - DNA, 20 bp, Artificial Sequence
  Description of Artificial Sequence: Synthetic oligonucleotide
  Target: SOD1; (+) strand; PAM type: YTN; PAM sequence: CTA
agcccagcggggtgaggctg

SEQ ID NO: 14936 - DNA, 20 bp, Artificial Sequence
  Description of Artificial Sequence: Synthetic oligonucleotide
  Target: SOD1; (+) strand; PAM type: YTN; PAM sequence: CTG
tagtgagtcaagactgcacc

SEQ ID NO: 14937 - DNA, 20 bp, Artificial Sequence
  Description of Artificial Sequence: Synthetic oligonucleotide
  Target: SOD1; (+) strand; PAM type: YTN; PAM sequence: CTG
caccaccgcactccagcccg

SEQ ID NO: 14938 - DNA, 20 bp, Artificial Sequence
  Description of Artificial Sequence: Synthetic oligonucleotide
  Target: SOD1; (+) strand; PAM type: YTN; PAM sequence: CTC
cagcccgggcgacagagcaa

SEQ ID NO: 14939 - DNA, 20 bp, Artificial Sequence
  Description of Artificial Sequence: Synthetic oligonucleotide
  Target: SOD1; (+) strand; PAM type: YTN; PAM sequence: CTC
catctaaaaaaaaaaaaatt

SEQ ID NO: 14940 - DNA, 20 bp, Artificial Sequence
  Description of Artificial Sequence: Synthetic oligonucleotide
  Target: SOD1; (+) strand; PAM type: YTN; PAM sequence: CTA
aaaaaaaaaaaatttctggt

SEQ ID NO: 14941 - DNA, 20 bp, Artificial Sequence
  Description of Artificial Sequence: Synthetic oligonucleotide
  Target: SOD1; (+) strand; PAM type: YTN; PAM sequence: TTT
ctggtctacctttttgccca

SEQ ID NO: 14942 - DNA, 20 bp, Artificial Sequence
  Description of Artificial Sequence: Synthetic oligonucleotide
  Target: SOD1; (+) strand; PAM type: YTN; PAM sequence: TTC
tggtctacctttttgcccac

SEQ ID NO: 14943 - DNA, 20 bp, Artificial Sequence
  Description of Artificial Sequence: Synthetic oligonucleotide
  Target: SOD1; (+) strand; PAM type: YTN; PAM sequence: CTG
gtctacctttttgcccacct

SEQ ID NO: 14944 - DNA, 20 bp, Artificial Sequence
  Description of Artificial Sequence: Synthetic oligonucleotide
  Target: SOD1; (+) strand; PAM type: YTN; PAM sequence: CTA
cctttttgcccaccttttaa

SEQ ID NO: 14945 - DNA, 20 bp, Artificial Sequence
  Description of Artificial Sequence: Synthetic oligonucleotide
  Target: SOD1; (+) strand; PAM type: YTN; PAM sequence: CTT
tttgcccaccttttaaccac

SEQ ID NO: 14946 - DNA, 20 bp, Artificial Sequence
  Description of Artificial Sequence: Synthetic oligonucleotide
  Target: SOD1; (+) strand; PAM type: YTN; PAM sequence: TTT
ttgcccaccttttaaccaca

SEQ ID NO: 14947 - DNA, 20 bp, Artificial Sequence
  Description of Artificial Sequence: Synthetic oligonucleotide
  Target: SOD1; (+) strand; PAM type: YTN; PAM sequence: TTT
tgcccaccttttaaccacag

SEQ ID NO: 14948 - DNA, 20 bp, Artificial Sequence
  Description of Artificial Sequence: Synthetic oligonucleotide
  Target: SOD1; (+) strand; PAM type: YTN; PAM sequence: TTT
gcccaccttttaaccacaga

SEQ ID NO: 14949 - DNA, 20 bp, Artificial Sequence
  Description of Artificial Sequence: Synthetic oligonucleotide
  Target: SOD1; (+) strand; PAM type: YTN; PAM sequence: TTG
cccaccttttaaccacagag

SEQ ID NO: 14950 - DNA, 20 bp, Artificial Sequence
  Description of Artificial Sequence: Synthetic oligonucleotide
  Target: SOD1; (+) strand; PAM type: YTN; PAM sequence: CTT
ttaaccacagaggtccccaa

SEQ ID NO: 14951 - DNA, 20 bp, Artificial Sequence
  Description of Artificial Sequence: Synthetic oligonucleotide
  Target: SOD1; (+) strand; PAM type: YTN; PAM sequence: TTT
taaccacagaggtccccaaa

SEQ ID NO: 14952 - DNA, 20 bp, Artificial Sequence
  Description of Artificial Sequence: Synthetic oligonucleotide
  Target: SOD1; (+) strand; PAM type: YTN; PAM sequence: TTT
aaccacagaggtccccaaac

SEQ ID NO: 14953 - DNA, 20 bp, Artificial Sequence
  Description of Artificial Sequence: Synthetic oligonucleotide
  Target: SOD1; (+) strand; PAM type: YTN; PAM sequence: TTA
accacagaggtccccaaaca

SEQ ID NO: 14954 - DNA, 20 bp, Artificial Sequence
  Description of Artificial Sequence: Synthetic oligonucleotide
  Target: SOD1; (+) strand; PAM type: YTN; PAM sequence: TTT
tcactctcaggaaggctgaa

SEQ ID NO: 14955 - DNA, 20 bp, Artificial Sequence
  Description of Artificial Sequence: Synthetic oligonucleotide
  Target: SOD1; (+) strand; PAM type: YTN; PAM sequence: TTT
cactctcaggaaggctgaaa

SEQ ID NO: 14956 - DNA, 20 bp, Artificial Sequence
  Description of Artificial Sequence: Synthetic oligonucleotide
  Target: SOD1; (+) strand; PAM type: YTN; PAM sequence: TTC
actctcaggaaggctgaaat

SEQ ID NO: 14957 - DNA, 20 bp, Artificial Sequence
  Description of Artificial Sequence: Synthetic oligonucleotide
  Target: SOD1; (+) strand; PAM type: YTN; PAM sequence: CTC
tcaggaaggctgaaatgaca

SEQ ID NO: 14958 - DNA, 20 bp, Artificial Sequence
  Description of Artificial Sequence: Synthetic oligonucleotide
  Target: SOD1; (+) strand; PAM type: YTN; PAM sequence: CTC
aggaaggctgaaatgacaca

SEQ ID NO: 14959 - DNA, 20 bp, Artificial Sequence
  Description of Artificial Sequence: Synthetic oligonucleotide
  Target: SOD1; (+) strand; PAM type: YTN; PAM sequence: CTG
aaatgacacattacaagcgg

SEQ ID NO: 14960 - DNA, 20 bp, Artificial Sequence
  Description of Artificial Sequence: Synthetic oligonucleotide
  Target: SOD1; (+) strand; PAM type: YTN; PAM sequence: TTA
caagcggtttagtcatctgc

SEQ ID NO: 14961 - DNA, 20 bp, Artificial Sequence
  Description of Artificial Sequence: Synthetic oligonucleotide
  Target: SOD1; (+) strand; PAM type: YTN; PAM sequence: TTT
agtcatctgcacgtgccgcc

SEQ ID NO: 14962 - DNA, 20 bp, Artificial Sequence
  Description of Artificial Sequence: Synthetic oligonucleotide
  Target: SOD1; (+) strand; PAM type: YTN; PAM sequence: TTA
gtcatctgcacgtgccgcca

SEQ ID NO: 14963 - DNA, 20 bp, Artificial Sequence
  Description of Artificial Sequence: Synthetic oligonucleotide
  Target: SOD1; (+) strand; PAM type: YTN; PAM sequence: CTG
cacgtgccgccatctgattt

SEQ ID NO: 14964 - DNA, 20 bp, Artificial Sequence
  Description of Artificial Sequence: Synthetic oligonucleotide
  Target: SOD1; (+) strand; PAM type: YTN; PAM sequence: CTG
atttaaggcatctattcctc

SEQ ID NO: 14965 - DNA, 20 bp, Artificial Sequence
  Description of Artificial Sequence: Synthetic oligonucleotide
  Target: SOD1; (+) strand; PAM type: YTN; PAM sequence: TTT
aaggcatctattcctcctca

SEQ ID NO: 14966 - DNA, 20 bp, Artificial Sequence
  Description of Artificial Sequence: Synthetic oligonucleotide
  Target: SOD1; (+) strand; PAM type: YTN; PAM sequence: TTA
aggcatctattcctcctcac

SEQ ID NO: 14967 - DNA, 20 bp, Artificial Sequence
  Description of Artificial Sequence: Synthetic oligonucleotide
  Target: SOD1; (+) strand; PAM type: YTN; PAM sequence: CTA
ttcctcctcaccattcctga

SEQ ID NO: 14968 - DNA, 20 bp, Artificial Sequence
  Description of Artificial Sequence: Synthetic oligonucleotide
  Target: SOD1; (+) strand; PAM type: YTN; PAM sequence: TTC
ctcctcaccattcctgacaa

SEQ ID NO: 14969 - DNA, 20 bp, Artificial Sequence
  Description of Artificial Sequence: Synthetic oligonucleotide
  Target: SOD1; (+) strand; PAM type: YTN; PAM sequence: CTC
ctcaccattcctgacaaagt

SEQ ID NO: 14970 - DNA, 20 bp, Artificial Sequence
  Description of Artificial Sequence: Synthetic oligonucleotide
  Target: SOD1; (+) strand; PAM type: YTN; PAM sequence: CTC
accattcctgacaaagttga

SEQ ID NO: 14971 - DNA, 20 bp, Artificial Sequence
  Description of Artificial Sequence: Synthetic oligonucleotide
  Target: SOD1; (+) strand; PAM type: YTN; PAM sequence: TTC
ctgacaaagttgaactgtct

SEQ ID NO: 14972 - DNA, 20 bp, Artificial Sequence
  Description of Artificial Sequence: Synthetic oligonucleotide
  Target: SOD1; (+) strand; PAM type: YTN; PAM sequence: CTG
acaaagttgaactgtctaca

SEQ ID NO: 14973 - DNA, 20 bp, Artificial Sequence
  Description of Artificial Sequence: Synthetic oligonucleotide
  Target: SOD1; (+) strand; PAM type: YTN; PAM sequence: TTG
aactgtctacatgtgccaca

SEQ ID NO: 14974 - DNA, 20 bp, Artificial Sequence
  Description of Artificial Sequence: Synthetic oligonucleotide
  Target: SOD1; (+) strand; PAM type: YTN; PAM sequence: CTG
tctacatgtgccacattctc

SEQ ID NO: 14975 - DNA, 20 bp, Artificial Sequence
  Description of Artificial Sequence: Synthetic oligonucleotide
  Target: SOD1; (+) strand; PAM type: YTN; PAM sequence: CTA
catgtgccacattctcctct

SEQ ID NO: 14976 - DNA, 20 bp, Artificial Sequence
  Description of Artificial Sequence: Synthetic oligonucleotide
  Target: SOD1; (+) strand; PAM type: YTN; PAM sequence: TTC
tcctctttctctaattcctt

SEQ ID NO: 14977 - DNA, 20 bp, Artificial Sequence
  Description of Artificial Sequence: Synthetic oligonucleotide
  Target: SOD1; (+) strand; PAM type: YTN; PAM sequence: CTC
ctctttctctaattccttcc

SEQ ID NO: 14978 - DNA, 20 bp, Artificial Sequence
  Description of Artificial Sequence: Synthetic oligonucleotide
  Target: SOD1; (+) strand; PAM type: YTN; PAM sequence: CTC
tttctctaattccttccctc

SEQ ID NO: 14979 - DNA, 20 bp, Artificial Sequence
  Description of Artificial Sequence: Synthetic oligonucleotide
  Target: SOD1; (+) strand; PAM type: YTN; PAM sequence: CTT
tctctaattccttccctcct

SEQ ID NO: 14980 - DNA, 20 bp, Artificial Sequence
  Description of Artificial Sequence: Synthetic oligonucleotide
  Target: SOD1; (+) strand; PAM type: YTN; PAM sequence: TTT
ctctaattccttccctcctt

SEQ ID NO: 14981 - DNA, 20 bp, Artificial Sequence
  Description of Artificial Sequence: Synthetic oligonucleotide
  Target: SOD1; (+) strand; PAM type: YTN; PAM sequence: TTC
tctaattccttccctccttc

SEQ ID NO: 14982 - DNA, 20 bp, Artificial Sequence
  Description of Artificial Sequence: Synthetic oligonucleotide
  Target: SOD1; (+) strand; PAM type: YTN; PAM sequence: CTC
taattccttccctccttccc

SEQ ID NO: 14983 - DNA, 20 bp, Artificial Sequence
  Description of Artificial Sequence: Synthetic oligonucleotide
  Target: SOD1; (+) strand; PAM type: YTN; PAM sequence: CTA
attccttccctccttccctc

SEQ ID NO: 14984 - DNA, 20 bp, Artificial Sequence
  Description of Artificial Sequence: Synthetic oligonucleotide
  Target: SOD1; (+) strand; PAM type: YTN; PAM sequence: TTC
cttccctccttccctcctcc

SEQ ID NO: 14985 - DNA, 20 bp, Artificial Sequence
  Description of Artificial Sequence: Synthetic oligonucleotide
  Target: SOD1; (+) strand; PAM type: YTN; PAM sequence: CTT
ccctccttccctcctccctt

SEQ ID NO: 14986 - DNA, 20 bp, Artificial Sequence
  Description of Artificial Sequence: Synthetic oligonucleotide
  Target: SOD1; (+) strand; PAM type: YTN; PAM sequence: TTC
cctccttccctcctcccttt

SEQ ID NO: 14987 - DNA, 20 bp, Artificial Sequence
  Description of Artificial Sequence: Synthetic oligonucleotide
  Target: SOD1; (+) strand; PAM type: YTN; PAM sequence: CTC
cttccctcctccctttcttc

SEQ ID NO: 14988 - DNA, 20 bp, Artificial Sequence
  Description of Artificial Sequence: Synthetic oligonucleotide
  Target: SOD1; (+) strand; PAM type: YTN; PAM sequence: CTT
ccctcctccctttcttccct

SEQ ID NO: 14989 - DNA, 20 bp, Artificial Sequence
  Description of Artificial Sequence: Synthetic oligonucleotide
  Target: SOD1; (+) strand; PAM type: YTN; PAM sequence: TTC
cctcctccctttcttccctc

SEQ ID NO: 14990 - DNA, 20 bp, Artificial Sequence
  Description of Artificial Sequence: Synthetic oligonucleotide
  Target: SOD1; (+) strand; PAM type: YTN; PAM sequence: CTC
ctccctttcttccctccctc

SEQ ID NO: 14991 - DNA, 20 bp, Artificial Sequence
  Description of Artificial Sequence: Synthetic oligonucleotide
  Target: SOD1; (+) strand; PAM type: YTN; PAM sequence: CTC
cctttcttccctccctccct

SEQ ID NO: 14992 - DNA, 20 bp, Artificial Sequence
  Description of Artificial Sequence: Synthetic oligonucleotide
  Target: SOD1; (+) strand; PAM type: YTN; PAM sequence: CTT
tcttccctccctccctcctt

SEQ ID NO: 14993 - DNA, 20 bp, Artificial Sequence
  Description of Artificial Sequence: Synthetic oligonucleotide
  Target: SOD1; (+) strand; PAM type: YTN; PAM sequence: TTT
cttccctccctccctccttc

SEQ ID NO: 14994 - DNA, 20 bp, Artificial Sequence
  Description of Artificial Sequence: Synthetic oligonucleotide
  Target: SOD1; (+) strand; PAM type: YTN; PAM sequence: TTC
ttccctccctccctccttcc

SEQ ID NO: 14995 - DNA, 20 bp, Artificial Sequence
  Description of Artificial Sequence: Synthetic oligonucleotide
  Target: SOD1; (+) strand; PAM type: YTN; PAM sequence: CTT
ccctccctccctccttcctt

SEQ ID NO: 14996 - DNA, 20 bp, Artificial Sequence
  Description of Artificial Sequence: Synthetic oligonucleotide
  Target: SOD1; (+) strand; PAM type: YTN; PAM sequence: TTC
cctccctccctccttccttc

SEQ ID NO: 14997 - DNA, 20 bp, Artificial Sequence
  Description of Artificial Sequence: Synthetic oligonucleotide
  Target: SOD1; (+) strand; PAM type: YTN; PAM sequence: CTC
cctccctccttccttcttct

SEQ ID NO: 14998 - DNA, 20 bp, Artificial Sequence
  Description of Artificial Sequence: Synthetic oligonucleotide
  Target: SOD1; (+) strand; PAM type: YTN; PAM sequence: CTC
cctccttccttcttctttct

SEQ ID NO: 14999 - DNA, 20 bp, Artificial Sequence
  Description of Artificial Sequence: Synthetic oligonucleotide
  Target: SOD1; (+) strand; PAM type: YTN; PAM sequence: CTC
cttccttcttctttctcttt

SEQ ID NO: 15000 - DNA, 20 bp, Artificial Sequence
  Description of Artificial Sequence: Synthetic oligonucleotide
  Target: SOD1; (+) strand; PAM type: YTN; PAM sequence: CTT
ccttcttctttctctttctt

SEQ ID NO: 15001 - DNA, 20 bp, Artificial Sequence
  Description of Artificial Sequence: Synthetic oligonucleotide
  Target: SOD1; (+) strand; PAM type: YTN; PAM sequence: TTC
cttcttctttctctttcttt

SEQ ID NO: 15002 - DNA, 20 bp, Artificial Sequence
  Description of Artificial Sequence: Synthetic oligonucleotide
  Target: SOD1; (+) strand; PAM type: YTN; PAM sequence: CTT
cttctttctctttctttttc

SEQ ID NO: 15003 - DNA, 20 bp, Artificial Sequence
  Description of Artificial Sequence: Synthetic oligonucleotide
  Target: SOD1; (+) strand; PAM type: YTN; PAM sequence: TTC
ttctttctctttctttttct

SEQ ID NO: 15004 - DNA, 20 bp, Artificial Sequence
  Description of Artificial Sequence: Synthetic oligonucleotide
  Target: SOD1; (+) strand; PAM type: YTN; PAM sequence: CTT
ctttctctttctttttcttt

SEQ ID NO: 15005 - DNA, 20 bp, Artificial Sequence
  Description of Artificial Sequence: Synthetic oligonucleotide
  Target: SOD1; (+) strand; PAM type: YTN; PAM sequence: TTC
tttctctttctttttctttc

SEQ ID NO: 15006 - DNA, 20 bp, Artificial Sequence
  Description of Artificial Sequence: Synthetic oligonucleotide
  Target: SOD1; (+) strand; PAM type: YTN; PAM sequence: CTT
tctctttctttttctttctc

SEQ ID NO: 15007 - DNA, 20 bp, Artificial Sequence
  Description of Artificial Sequence: Synthetic oligonucleotide
  Target: SOD1; (+) strand; PAM type: YTN; PAM sequence: TTT
ctctttctttttctttctct

SEQ ID NO: 15008 - DNA, 20 bp, Artificial Sequence
  Description of Artificial Sequence: Synthetic oligonucleotide
  Target: SOD1; (+) strand; PAM type: YTN; PAM sequence: TTC
tctttctttttctttctctc

SEQ ID NO: 15009 - DNA, 20 bp, Artificial Sequence
  Description of Artificial Sequence: Synthetic oligonucleotide
  Target: SOD1; (+) strand; PAM type: YTN; PAM sequence: CTC
tttctttttctttctctctt

SEQ ID NO: 15010 - DNA, 20 bp, Artificial Sequence
  Description of Artificial Sequence: Synthetic oligonucleotide
  Target: SOD1; (+) strand; PAM type: YTN; PAM sequence: CTT
tctttttctttctctctttc

SEQ ID NO: 15011 - DNA, 20 bp, Artificial Sequence
  Description of Artificial Sequence: Synthetic oligonucleotide
  Target: SOD1; (+) strand; PAM type: YTN; PAM sequence: TTT
ctttttctttctctctttct

SEQ ID NO: 15012 - DNA, 20 bp, Artificial Sequence
  Description of Artificial Sequence: Synthetic oligonucleotide
  Target: SOD1; (+) strand; PAM type: YTN; PAM sequence: TTC
tttttctttctctctttctc

SEQ ID NO: 15013 - DNA, 20 bp, Artificial Sequence
  Description of Artificial Sequence: Synthetic oligonucleotide
  Target: SOD1; (+) strand; PAM type: YTN; PAM sequence: CTT
tttctttctctctttctctt

SEQ ID NO: 15014 - DNA, 20 bp, Artificial Sequence
  Description of Artificial Sequence: Synthetic oligonucleotide
  Target: SOD1; (+) strand; PAM type: YTN; PAM sequence: TTT
ttctttctctctttctcttt

SEQ ID NO: 15015 - DNA, 20 bp, Artificial Sequence
  Description of Artificial Sequence: Synthetic oligonucleotide
  Target: SOD1; (+) strand; PAM type: YTN; PAM sequence: TTT
tctttctctctttctctttc

SEQ ID NO: 15016 - DNA, 20 bp, Artificial Sequence
  Description of Artificial Sequence: Synthetic oligonucleotide
  Target: SOD1; (+) strand; PAM type: YTN; PAM sequence: TTT
ctttctctctttctctttct

SEQ ID NO: 15017 - DNA, 20 bp, Artificial Sequence
  Description of Artificial Sequence: Synthetic oligonucleotide
  Target: SOD1; (+) strand; PAM type: YTN; PAM sequence: TTC
tttctctctttctctttctt

SEQ ID NO: 15018 - DNA, 20 bp, Artificial Sequence
  Description of Artificial Sequence: Synthetic oligonucleotide
  Target: SOD1; (+) strand; PAM type: YTN; PAM sequence: CTT
tctctctttctctttctttc

SEQ ID NO: 15019 - DNA, 20 bp, Artificial Sequence
  Description of Artificial Sequence: Synthetic oligonucleotide
  Target: SOD1; (+) strand; PAM type: YTN; PAM sequence: TTT
ctctctttctctttctttct

SEQ ID NO: 15020 - DNA, 20 bp, Artificial Sequence
  Description of Artificial Sequence: Synthetic oligonucleotide
  Target: SOD1; (+) strand; PAM type: YTN; PAM sequence: TTC
tctctttctctttctttctc

SEQ ID NO: 15021 - DNA, 20 bp, Artificial Sequence
  Description of Artificial Sequence: Synthetic oligonucleotide
  Target: SOD1; (+) strand; PAM type: YTN; PAM sequence: CTC
tctttctctttctttctctt

SEQ ID NO: 15022 - DNA, 20 bp, Artificial Sequence
  Description of Artificial Sequence: Synthetic oligonucleotide
  Target: SOD1; (+) strand; PAM type: YTN; PAM sequence: CTC
tttctctttctttctctttc

SEQ ID NO: 15023 - DNA, 20 bp, Artificial Sequence
  Description of Artificial Sequence: Synthetic oligonucleotide
  Target: SOD1; (+) strand; PAM type: YTN; PAM sequence: CTT
tctctttctttctctttctc

SEQ ID NO: 15024 - DNA, 20 bp, Artificial Sequence
  Description of Artificial Sequence: Synthetic oligonucleotide
  Target: SOD1; (+) strand; PAM type: YTN; PAM sequence: TTT
ctctttctttctctttctct

SEQ ID NO: 15025 - DNA, 20 bp, Artificial Sequence
  Description of Artificial Sequence: Synthetic oligonucleotide
  Target: SOD1; (+) strand; PAM type: YTN; PAM sequence: TTC
tctttctttctctttctctc

SEQ ID NO: 15026 - DNA, 20 bp, Artificial Sequence
  Description of Artificial Sequence: Synthetic oligonucleotide
  Target: SOD1; (+) strand; PAM type: YTN; PAM sequence: CTC
tttctttctctttctctctc

SEQ ID NO: 15027 - DNA, 20 bp, Artificial Sequence
  Description of Artificial Sequence: Synthetic oligonucleotide
  Target: SOD1; (+) strand; PAM type: YTN; PAM sequence: CTT
tctttctctttctctctcac

SEQ ID NO: 15028 - DNA, 20 bp, Artificial Sequence
  Description of Artificial Sequence: Synthetic oligonucleotide
  Target: SOD1; (+) strand; PAM type: YTN; PAM sequence: TTT
ctttctctttctctctcact

SEQ ID NO: 15029 - DNA, 20 bp, Artificial Sequence
  Description of Artificial Sequence: Synthetic oligonucleotide
  Target: SOD1; (+) strand; PAM type: YTN; PAM sequence: TTC
tttctctttctctctcactc

SEQ ID NO: 15030 - DNA, 20 bp, Artificial Sequence
  Description of Artificial Sequence: Synthetic oligonucleotide
  Target: SOD1; (+) strand; PAM type: YTN; PAM sequence: CTT
tctctttctctctcactctc

SEQ ID NO: 15031 - DNA, 20 bp, Artificial Sequence
  Description of Artificial Sequence: Synthetic oligonucleotide
  Target: SOD1; (+) strand; PAM type: YTN; PAM sequence: TTT
ctctttctctctcactctct

SEQ ID NO: 15032 - DNA, 20 bp, Artificial Sequence
  Description of Artificial Sequence: Synthetic oligonucleotide
  Target: SOD1; (+) strand; PAM type: YTN; PAM sequence: TTC
tctttctctctcactctctt

SEQ ID NO: 15033 - DNA, 20 bp, Artificial Sequence
  Description of Artificial Sequence: Synthetic oligonucleotide
  Target: SOD1; (+) strand; PAM type: YTN; PAM sequence: CTC
tttctctctcactctctttt

SEQ ID NO: 15034 - DNA, 20 bp, Artificial Sequence
  Description of Artificial Sequence: Synthetic oligonucleotide
  Target: SOD1; (+) strand; PAM type: YTN; PAM sequence: CTT
tctctctcactctcttttct

SEQ ID NO: 15035 - DNA, 20 bp, Artificial Sequence
  Description of Artificial Sequence: Synthetic oligonucleotide
  Target: SOD1; (+) strand; PAM type: YTN; PAM sequence: TTT
ctctctcactctcttttctt

SEQ ID NO: 15036 - DNA, 20 bp, Artificial Sequence
  Description of Artificial Sequence: Synthetic oligonucleotide
  Target: SOD1; (+) strand; PAM type: YTN; PAM sequence: TTC
tctctcactctcttttcttc

SEQ ID NO: 15037 - DNA, 20 bp, Artificial Sequence
  Description of Artificial Sequence: Synthetic oligonucleotide
  Target: SOD1; (+) strand; PAM type: YTN; PAM sequence: CTC
tctcactctcttttcttctt

SEQ ID NO: 15038 - DNA, 20 bp, Artificial Sequence
  Description of Artificial Sequence: Synthetic oligonucleotide
  Target: SOD1; (+) strand; PAM type: YTN; PAM sequence: CTC
tcactctcttttcttctttc

SEQ ID NO: 15039 - DNA, 20 bp, Artificial Sequence
  Description of Artificial Sequence: Synthetic oligonucleotide
  Target: SOD1; (+) strand; PAM type: YTN; PAM sequence: CTC
actctcttttcttctttctg

SEQ ID NO: 15040 - DNA, 20 bp, Artificial Sequence
  Description of Artificial Sequence: Synthetic oligonucleotide
  Target: SOD1; (+) strand; PAM type: YTN; PAM sequence: CTC
tcttttcttctttctgacag

SEQ ID NO: 15041 - DNA, 20 bp, Artificial Sequence
  Description of Artificial Sequence: Synthetic oligonucleotide
  Target: SOD1; (+) strand; PAM type: YTN; PAM sequence: CTC
ttttcttctttctgacaggg

SEQ ID NO: 15042 - DNA, 20 bp, Artificial Sequence
  Description of Artificial Sequence: Synthetic oligonucleotide
  Target: SOD1; (+) strand; PAM type: YTN; PAM sequence: CTT
ttcttctttctgacagggtt

SEQ ID NO: 15043 - DNA, 20 bp, Artificial Sequence
  Description of Artificial Sequence: Synthetic oligonucleotide
  Target: SOD1; (+) strand; PAM type: YTN; PAM sequence: TTT
tcttctttctgacagggttt

SEQ ID NO: 15044 - DNA, 20 bp, Artificial Sequence
  Description of Artificial Sequence: Synthetic oligonucleotide
  Target: SOD1; (+) strand; PAM type: YTN; PAM sequence: TTT
cttctttctgacagggtttg

SEQ ID NO: 15045 - DNA, 20 bp, Artificial Sequence
  Description of Artificial Sequence: Synthetic oligonucleotide
  Target: SOD1; (+) strand; PAM type: YTN; PAM sequence: TTC
ttctttctgacagggtttgc

SEQ ID NO: 15046 - DNA, 20 bp, Artificial Sequence
  Description of Artificial Sequence: Synthetic oligonucleotide
  Target: SOD1; (+) strand; PAM type: YTN; PAM sequence: CTT
ctttctgacagggtttgcct

SEQ ID NO: 15047 - DNA, 20 bp, Artificial Sequence
  Description of Artificial Sequence: Synthetic oligonucleotide
  Target: SOD1; (+) strand; PAM type: YTN; PAM sequence: TTC
tttctgacagggtttgcctg

SEQ ID NO: 15048 - DNA, 20 bp, Artificial Sequence
  Description of Artificial Sequence: Synthetic oligonucleotide
  Target: SOD1; (+) strand; PAM type: YTN; PAM sequence: CTT
tctgacagggtttgcctgtt

SEQ ID NO: 15049 - DNA, 20 bp, Artificial Sequence
  Description of Artificial Sequence: Synthetic oligonucleotide
  Target: SOD1; (+) strand; PAM type: YTN; PAM sequence: TTT
ctgacagggtttgcctgttc

SEQ ID NO: 15050 - DNA, 20 bp, Artificial Sequence
  Description of Artificial Sequence: Synthetic oligonucleotide
  Target: SOD1; (+) strand; PAM type: YTN; PAM sequence: TTC
tgacagggtttgcctgttct

SEQ ID NO: 15051 - DNA, 20 bp, Artificial Sequence
  Description of Artificial Sequence: Synthetic oligonucleotide
  Target: SOD1; (+) strand; PAM type: YTN; PAM sequence: CTG
acagggtttgcctgttctgc

SEQ ID NO: 15052 - DNA, 20 bp, Artificial Sequence
  Description of Artificial Sequence: Synthetic oligonucleotide
  Target: SOD1; (+) strand; PAM type: YTN; PAM sequence: TTT
gcctgttctgcttctttaaa

SEQ ID NO: 15053 - DNA, 20 bp, Artificial Sequence
  Description of Artificial Sequence: Synthetic oligonucleotide
  Target: SOD1; (+) strand; PAM type: YTN; PAM sequence: TTG
cctgttctgcttctttaaac

SEQ ID NO: 15054 - DNA, 20 bp, Artificial Sequence
  Description of Artificial Sequence: Synthetic oligonucleotide
  Target: SOD1; (+) strand; PAM type: YTN; PAM sequence: CTG
ttctgcttctttaaaccctg

SEQ ID NO: 15055 - DNA, 20 bp, Artificial Sequence
  Description of Artificial Sequence: Synthetic oligonucleotide
  Target: SOD1; (+) strand; PAM type: YTN; PAM sequence: TTC
tgcttctttaaaccctgggg

SEQ ID NO: 15056 - DNA, 20 bp, Artificial Sequence
  Description of Artificial Sequence: Synthetic oligonucleotide
  Target: SOD1; (+) strand; PAM type: YTN; PAM sequence: CTG
cttctttaaaccctggggtt

SEQ ID NO: 15057 - DNA, 20 bp, Artificial Sequence
  Description of Artificial Sequence: Synthetic oligonucleotide
  Target: SOD1; (+) strand; PAM type: YTN; PAM sequence: CTT
ctttaaaccctggggttcaa

SEQ ID NO: 15058 - DNA, 20 bp, Artificial Sequence
  Description of Artificial Sequence: Synthetic oligonucleotide
  Target: SOD1; (+) strand; PAM type: YTN; PAM sequence: TTC
tttaaaccctggggttcaag

SEQ ID NO: 15059 - DNA, 20 bp, Artificial Sequence
  Description of Artificial Sequence: Synthetic oligonucleotide
  Target: SOD1; (+) strand; PAM type: YTN; PAM sequence: CTT
taaaccctggggttcaagtg

SEQ ID NO: 15060 - DNA, 20 bp, Artificial Sequence
  Description of Artificial Sequence: Synthetic oligonucleotide
  Target: SOD1; (+) strand; PAM type: YTN; PAM sequence: TTT
aaaccctggggttcaagtgc

SEQ ID NO: 15061 - DNA, 20 bp, Artificial Sequence
  Description of Artificial Sequence: Synthetic oligonucleotide
  Target: SOD1; (+) strand; PAM type: YTN; PAM sequence: TTA
aaccctggggttcaagtgca

SEQ ID NO: 15062 - DNA, 20 bp, Artificial Sequence
  Description of Artificial Sequence: Synthetic oligonucleotide
  Target: SOD1; (+) strand; PAM type: YTN; PAM sequence: CTG
gggttcaagtgcaaaggtcc

SEQ ID NO: 15063 - DNA, 20 bp, Artificial Sequence
  Description of Artificial Sequence: Synthetic oligonucleotide
  Target: SOD1; (+) strand; PAM type: YTN; PAM sequence: TTC
aagtgcaaaggtccctctca

SEQ ID NO: 15064 - DNA, 20 bp, Artificial Sequence
  Description of Artificial Sequence: Synthetic oligonucleotide
  Target: SOD1; (+) strand; PAM type: YTN; PAM sequence: CTC
tcatctgatttccctatttt

SEQ ID NO: 15065 - DNA, 20 bp, Artificial Sequence
  Description of Artificial Sequence: Synthetic oligonucleotide
  Target: SOD1; (+) strand; PAM type: YTN; PAM sequence: CTC
atctgatttccctattttat

SEQ ID NO: 15066 - DNA, 20 bp, Artificial Sequence
  Description of Artificial Sequence: Synthetic oligonucleotide
  Target: SOD1; (+) strand; PAM type: YTN; PAM sequence: CTG
atttccctattttattttat

SEQ ID NO: 15067 - DNA, 20 bp, Artificial Sequence
  Description of Artificial Sequence: Synthetic oligonucleotide
  Target: SOD1; (+) strand; PAM type: YTN; PAM sequence: TTT
ccctattttattttatttaa

SEQ ID NO: 15068 - DNA, 20 bp, Artificial Sequence
  Description of Artificial Sequence: Synthetic oligonucleotide
  Target: SOD1; (+) strand; PAM type: YTN; PAM sequence: TTC
cctattttattttatttaag

SEQ ID NO: 15069 - DNA, 20 bp, Artificial Sequence
  Description of Artificial Sequence: Synthetic oligonucleotide
  Target: SOD1; (+) strand; PAM type: YTN; PAM sequence: CTA
ttttattttatttaagttag

SEQ ID NO: 15070 - DNA, 20 bp, Artificial Sequence
  Description of Artificial Sequence: Synthetic oligonucleotide
  Target: SOD1; (+) strand; PAM type: YTN; PAM sequence: TTT
tattttatttaagttagata

SEQ ID NO: 15071 - DNA, 20 bp, Artificial Sequence
  Description of Artificial Sequence: Synthetic oligonucleotide
  Target: SOD1; (+) strand; PAM type: YTN; PAM sequence: TTT
attttatttaagttagatac

SEQ ID NO: 15072 - DNA, 20 bp, Artificial Sequence
  Description of Artificial Sequence: Synthetic oligonucleotide
  Target: SOD1; (+) strand; PAM type: YTN; PAM sequence: TTA
ttttatttaagttagatact

SEQ ID NO: 15073 - DNA, 20 bp, Artificial Sequence
  Description of Artificial Sequence: Synthetic oligonucleotide
  Target: SOD1; (+) strand; PAM type: YTN; PAM sequence: TTT
tatttaagttagatactcca

SEQ ID NO: 15074 - DNA, 20 bp, Artificial Sequence
  Description of Artificial Sequence: Synthetic oligonucleotide
  Target: SOD1; (+) strand; PAM type: YTN; PAM sequence: TTT
atttaagttagatactccac

SEQ ID NO: 15075 - DNA, 20 bp, Artificial Sequence
  Description of Artificial Sequence: Synthetic oligonucleotide
  Target: SOD1; (+) strand; PAM type: YTN; PAM sequence: TTA
tttaagttagatactccacg

SEQ ID NO: 15076 - DNA, 20 bp, Artificial Sequence
  Description of Artificial Sequence: Synthetic oligonucleotide
  Target: SOD1; (+) strand; PAM type: YTN; PAM sequence: TTT
aagttagatactccacgatg

SEQ ID NO: 15077 - DNA, 20 bp, Artificial Sequence
  Description of Artificial Sequence: Synthetic oligonucleotide
  Target: SOD1; (+) strand; PAM type: YTN; PAM sequence: TTA
agttagatactccacgatga

SEQ ID NO: 15078 - DNA, 20 bp, Artificial Sequence
  Description of Artificial Sequence: Synthetic oligonucleotide
  Target: SOD1; (+) strand; PAM type: YTN; PAM sequence: TTA
gatactccacgatgatgatg

SEQ ID NO: 15079 - DNA, 20 bp, Artificial Sequence
  Description of Artificial Sequence: Synthetic oligonucleotide
  Target: SOD1; (+) strand; PAM type: YTN; PAM sequence: CTC
cacgatgatgatgatgatta

SEQ ID NO: 15080 - DNA, 20 bp, Artificial Sequence
  Description of Artificial Sequence: Synthetic oligonucleotide
  Target: SOD1; (+) strand; PAM type: YTN; PAM sequence: TTA
ttgttgagacaggatttcat

SEQ ID NO: 15081 - DNA, 20 bp, Artificial Sequence
  Description of Artificial Sequence: Synthetic oligonucleotide
  Target: SOD1; (+) strand; PAM type: YTN; PAM sequence: TTG
ttgagacaggatttcattct

SEQ ID NO: 15082 - DNA, 20 bp, Artificial Sequence
  Description of Artificial Sequence: Synthetic oligonucleotide
  Target: SOD1; (+) strand; PAM type: YTN; PAM sequence: TTG
agacaggatttcattctgtt

SEQ ID NO: 15083 - DNA, 20 bp, Artificial Sequence
  Description of Artificial Sequence: Synthetic oligonucleotide
  Target: SOD1; (+) strand; PAM type: YTN; PAM sequence: TTT
cattctgttgcccaggctgg

SEQ ID NO: 15084 - DNA, 20 bp, Artificial Sequence
  Description of Artificial Sequence: Synthetic oligonucleotide
  Target: SOD1; (+) strand; PAM type: YTN; PAM sequence: TTC
attctgttgcccaggctgga

SEQ ID NO: 15085 - DNA, 20 bp, Artificial Sequence
  Description of Artificial Sequence: Synthetic oligonucleotide
  Target: SOD1; (+) strand; PAM type: YTN; PAM sequence: TTC
tgttgcccaggctggagtgc

SEQ ID NO: 15086 - DNA, 20 bp, Artificial Sequence
  Description of Artificial Sequence: Synthetic oligonucleotide
  Target: SOD1; (+) strand; PAM type: YTN; PAM sequence: CTG
ttgcccaggctggagtgcaa

SEQ ID NO: 15087 - DNA, 20 bp, Artificial Sequence
  Description of Artificial Sequence: Synthetic oligonucleotide
  Target: SOD1; (+) strand; PAM type: YTN; PAM sequence: TTG
cccaggctggagtgcaatgg

SEQ ID NO: 15088 - DNA, 20 bp, Artificial Sequence
  Description of Artificial Sequence: Synthetic oligonucleotide
  Target: SOD1; (+) strand; PAM type: YTN; PAM sequence: CTG
gagtgcaatggtgcgatcac

SEQ ID NO: 15089 - DNA, 20 bp, Artificial Sequence
  Description of Artificial Sequence: Synthetic oligonucleotide
  Target: SOD1; (+) strand; PAM type: YTN; PAM sequence: CTC
actgcagcctcaacctcctg

SEQ ID NO: 15090 - DNA, 20 bp, Artificial Sequence
  Description of Artificial Sequence: Synthetic oligonucleotide
  Target: SOD1; (+) strand; PAM type: YTN; PAM sequence: CTG
cagcctcaacctcctgggcc

SEQ ID NO: 15091 - DNA, 20 bp, Artificial Sequence
  Description of Artificial Sequence: Synthetic oligonucleotide
  Target: SOD1; (+) strand; PAM type: YTN; PAM sequence: CTC
aacctcctgggcccacgcga

SEQ ID NO: 15092 - DNA, 20 bp, Artificial Sequence
  Description of Artificial Sequence: Synthetic oligonucleotide
  Target: SOD1; (+) strand; PAM type: YTN; PAM sequence: CTC
ctgggcccacgcgatcctcc

SEQ ID NO: 15093 - DNA, 20 bp, Artificial Sequence
  Description of Artificial Sequence: Synthetic oligonucleotide
  Target: SOD1; (+) strand; PAM type: YTN; PAM sequence: CTG
ggcccacgcgatcctcctac

SEQ ID NO: 15094 - DNA, 20 bp, Artificial Sequence
  Description of Artificial Sequence: Synthetic oligonucleotide
  Target: SOD1; (+) strand; PAM type: YTN; PAM sequence: CTC
ctacctcagcctcccaagta

SEQ ID NO: 15095 - DNA, 20 bp, Artificial Sequence
  Description of Artificial Sequence: Synthetic oligonucleotide
  Target: SOD1; (+) strand; PAM type: YTN; PAM sequence: CTA
cctcagcctcccaagtagct

SEQ ID NO: 15096 - DNA, 20 bp, Artificial Sequence
  Description of Artificial Sequence: Synthetic oligonucleotide
  Target: SOD1; (+) strand; PAM type: YTN; PAM sequence: CTC
agcctcccaagtagcttgga

SEQ ID NO: 15097 - DNA, 20 bp, Artificial Sequence
  Description of Artificial Sequence: Synthetic oligonucleotide
  Target: SOD1; (+) strand; PAM type: YTN; PAM sequence: CTC
ccaagtagcttggactacag

SEQ ID NO: 15098 - DNA, 20 bp, Artificial Sequence
  Description of Artificial Sequence: Synthetic oligonucleotide
  Target: SOD1; (+) strand; PAM type: YTN; PAM sequence: CTT
ggactacaggggtgtaccac

SEQ ID NO: 15099 - DNA, 20 bp, Artificial Sequence
  Description of Artificial Sequence: Synthetic oligonucleotide
  Target: SOD1; (+) strand; PAM type: YTN; PAM sequence: TTG
gactacaggggtgtaccacc

SEQ ID NO: 15100 - DNA, 20 bp, Artificial Sequence
  Description of Artificial Sequence: Synthetic oligonucleotide
  Target: SOD1; (+) strand; PAM type: YTN; PAM sequence: CTA
caggggtgtaccaccatgcc

SEQ ID NO: 15101 - DNA, 20 bp, Artificial Sequence
  Description of Artificial Sequence: Synthetic oligonucleotide
  Target: SOD1; (+) strand; PAM type: YTN; PAM sequence: CTA
attacatgtgccagattcaa

SEQ ID NO: 15102 - DNA, 20 bp, Artificial Sequence
  Description of Artificial Sequence: Synthetic oligonucleotide
  Target: SOD1; (+) strand; PAM type: YTN; PAM sequence: TTA
catgtgccagattcaaccca

SEQ ID NO: 15103 - DNA, 20 bp, Artificial Sequence
  Description of Artificial Sequence: Synthetic oligonucleotide
  Target: SOD1; (+) strand; PAM type: YTN; PAM sequence: TTC
aacccacgttccagggttcc

SEQ ID NO: 15104 - DNA, 20 bp, Artificial Sequence
  Description of Artificial Sequence: Synthetic oligonucleotide
  Target: SOD1; (+) strand; PAM type: YTN; PAM sequence: TTC
cagggttccaaacaaccaag

SEQ ID NO: 15105 - DNA, 20 bp, Artificial Sequence
  Description of Artificial Sequence: Synthetic oligonucleotide
  Target: SOD1; (+) strand; PAM type: YTN; PAM sequence: TTC
caaacaaccaaggctctatc

SEQ ID NO: 15106 - DNA, 20 bp, Artificial Sequence
  Description of Artificial Sequence: Synthetic oligonucleotide
  Target: SOD1; (+) strand; PAM type: YTN; PAM sequence: CTC
tatcatcctgtcttaacaaa

SEQ ID NO: 15107 - DNA, 20 bp, Artificial Sequence
  Description of Artificial Sequence: Synthetic oligonucleotide
  Target: SOD1; (+) strand; PAM type: YTN; PAM sequence: CTA
tcatcctgtcttaacaaata

SEQ ID NO: 15108 - DNA, 20 bp, Artificial Sequence
  Description of Artificial Sequence: Synthetic oligonucleotide
  Target: SOD1; (+) strand; PAM type: YTN; PAM sequence: CTG
tcttaacaaatataccttca

SEQ ID NO: 15109 - DNA, 20 bp, Artificial Sequence
  Description of Artificial Sequence: Synthetic oligonucleotide
  Target: SOD1; (+) strand; PAM type: YTN; PAM sequence: CTT
aacaaatataccttcataaa

SEQ ID NO: 15110 - DNA, 20 bp, Artificial Sequence
  Description of Artificial Sequence: Synthetic oligonucleotide
  Target: SOD1; (+) strand; PAM type: YTN; PAM sequence: TTA
acaaatataccttcataaag

SEQ ID NO: 15111 - DNA, 20 bp, Artificial Sequence
  Description of Artificial Sequence: Synthetic oligonucleotide
  Target: SOD1; (+) strand; PAM type: YTN; PAM sequence: CTT
cataaagacctggaaggcag

SEQ ID NO: 15112 - DNA, 20 bp, Artificial Sequence
  Description of Artificial Sequence: Synthetic oligonucleotide
  Target: SOD1; (+) strand; PAM type: YTN; PAM sequence: TTC
ataaagacctggaaggcagg

SEQ ID NO: 15113 - DNA, 20 bp, Artificial Sequence
  Description of Artificial Sequence: Synthetic oligonucleotide
  Target: SOD1; (+) strand; PAM type: YTN; PAM sequence: CTG
gaaggcaggttgaaatgtgg

SEQ ID NO: 15114 - DNA, 20 bp, Artificial Sequence
  Description of Artificial Sequence: Synthetic oligonucleotide
  Target: SOD1; (+) strand; PAM type: YTN; PAM sequence: TTG
aaatgtggaattcttggact

SEQ ID NO: 15115 - DNA, 20 bp, Artificial Sequence
  Description of Artificial Sequence: Synthetic oligonucleotide
  Target: SOD1; (+) strand; PAM type: YTN; PAM sequence: TTC
ttggacttctttcagttcta

SEQ ID NO: 15116 - DNA, 20 bp, Artificial Sequence
  Description of Artificial Sequence: Synthetic oligonucleotide
  Target: SOD1; (+) strand; PAM type: YTN; PAM sequence: CTT
ggacttctttcagttctacg

SEQ ID NO: 15117 - DNA, 20 bp, Artificial Sequence
  Description of Artificial Sequence: Synthetic oligonucleotide
  Target: SOD1; (+) strand; PAM type: YTN; PAM sequence: TTG
gacttctttcagttctacgt

SEQ ID NO: 15118 - DNA, 20 bp, Artificial Sequence
  Description of Artificial Sequence: Synthetic oligonucleotide
  Target: SOD1; (+) strand; PAM type: YTN; PAM sequence: CTT
ctttcagttctacgtagaag

SEQ ID NO: 15119 - DNA, 20 bp, Artificial Sequence
  Description of Artificial Sequence: Synthetic oligonucleotide
  Target: SOD1; (+) strand; PAM type: YTN; PAM sequence: TTC
tttcagttctacgtagaagg

SEQ ID NO: 15120 - DNA, 20 bp, Artificial Sequence
  Description of Artificial Sequence: Synthetic oligonucleotide
  Target: SOD1; (+) strand; PAM type: YTN; PAM sequence: CTT
tcagttctacgtagaagggt

SEQ ID NO: 15121 - DNA, 20 bp, Artificial Sequence
  Description of Artificial Sequence: Synthetic oligonucleotide
  Target: SOD1; (+) strand; PAM type: YTN; PAM sequence: TTT
cagttctacgtagaagggta

SEQ ID NO: 15122 - DNA, 20 bp, Artificial Sequence
  Description of Artificial Sequence: Synthetic oligonucleotide
  Target: SOD1; (+) strand; PAM type: YTN; PAM sequence: TTC
agttctacgtagaagggtag

SEQ ID NO: 15123 - DNA, 20 bp, Artificial Sequence
  Description of Artificial Sequence: Synthetic oligonucleotide
  Target: SOD1; (+) strand; PAM type: YTN; PAM sequence: TTC
tacgtagaagggtagcagtg

SEQ ID NO: 15124 - DNA, 20 bp, Artificial Sequence
  Description of Artificial Sequence: Synthetic oligonucleotide
  Target: SOD1; (+) strand; PAM type: YTN; PAM sequence: CTA
cgtagaagggtagcagtgga

SEQ ID NO: 15125 - DNA, 20 bp, Artificial Sequence
  Description of Artificial Sequence: Synthetic oligonucleotide
  Target: SOD1; (+) strand; PAM type: YTN; PAM sequence: CTG
gctgcctgcccgcccctggc

SEQ ID NO: 15126 - DNA, 20 bp, Artificial Sequence
  Description of Artificial Sequence: Synthetic oligonucleotide
  Target: SOD1; (+) strand; PAM type: YTN; PAM sequence: CTG
cctgcccgcccctggccttt

SEQ ID NO: 15127 - DNA, 20 bp, Artificial Sequence
  Description of Artificial Sequence: Synthetic oligonucleotide
  Target: SOD1; (+) strand; PAM type: YTN; PAM sequence: CTG
cccgcccctggcctttcctc

SEQ ID NO: 15128 - DNA, 20 bp, Artificial Sequence
  Description of Artificial Sequence: Synthetic oligonucleotide
  Target: SOD1; (+) strand; PAM type: YTN; PAM sequence: CTG
gcctttcctcctttccccac

SEQ ID NO: 15129 - DNA, 20 bp, Artificial Sequence
  Description of Artificial Sequence: Synthetic oligonucleotide
  Target: SOD1; (+) strand; PAM type: YTN; PAM sequence: CTT
tcctcctttccccacccctg

SEQ ID NO: 15130 - DNA, 20 bp, Artificial Sequence
  Description of Artificial Sequence: Synthetic oligonucleotide
  Target: SOD1; (+) strand; PAM type: YTN; PAM sequence: TTT
cctcctttccccacccctgc

SEQ ID NO: 15131 - DNA, 20 bp, Artificial Sequence
  Description of Artificial Sequence: Synthetic oligonucleotide
  Target: SOD1; (+) strand; PAM type: YTN; PAM sequence: TTC
ctcctttccccacccctgct

SEQ ID NO: 15132 - DNA, 20 bp, Artificial Sequence
  Description of Artificial Sequence: Synthetic oligonucleotide
  Target: SOD1; (+) strand; PAM type: YTN; PAM sequence: CTC
ctttccccacccctgctcct

SEQ ID NO: 15133 - DNA, 20 bp, Artificial Sequence
  Description of Artificial Sequence: Synthetic oligonucleotide
  Target: SOD1; (+) strand; PAM type: YTN; PAM sequence: CTT
tccccacccctgctccttgt

SEQ ID NO: 15134 - DNA, 20 bp, Artificial Sequence
  Description of Artificial Sequence: Synthetic oligonucleotide
  Target: SOD1; (+) strand; PAM type: YTN; PAM sequence: TTT
ccccacccctgctccttgtg

SEQ ID NO: 15135 - DNA, 20 bp, Artificial Sequence
  Description of Artificial Sequence: Synthetic oligonucleotide
  Target: SOD1; (+) strand; PAM type: YTN; PAM sequence: TTC
cccacccctgctccttgtgg

SEQ ID NO: 15136 - DNA, 20 bp, Artificial Sequence
  Description of Artificial Sequence: Synthetic oligonucleotide
  Target: SOD1; (+) strand; PAM type: YTN; PAM sequence: CTG
ctccttgtggcactgggcag

SEQ ID NO: 15137 - DNA, 20 bp, Artificial Sequence
  Description of Artificial Sequence: Synthetic oligonucleotide
  Target: SOD1; (+) strand; PAM type: YTN; PAM sequence: CTC
cttgtggcactgggcagggc

SEQ ID NO: 15138 - DNA, 20 bp, Artificial Sequence
  Description of Artificial Sequence: Synthetic oligonucleotide
  Target: SOD1; (+) strand; PAM type: YTN; PAM sequence: CTT
gtggcactgggcagggccta

SEQ ID NO: 15139 - DNA, 20 bp, Artificial Sequence
  Description of Artificial Sequence: Synthetic oligonucleotide
  Target: SOD1; (+) strand; PAM type: YTN; PAM sequence: TTG
tggcactgggcagggcctac

SEQ ID NO: 15140 - DNA, 20 bp, Artificial Sequence
  Description of Artificial Sequence: Synthetic oligonucleotide
  Target: SOD1; (+) strand; PAM type: YTN; PAM sequence: CTG
ggcagggcctacgttcaagg

SEQ ID NO: 15141 - DNA, 20 bp, Artificial Sequence
  Description of Artificial Sequence: Synthetic oligonucleotide
  Target: SOD1; (+) strand; PAM type: YTN; PAM sequence: CTA
cgttcaaggctagcagtgta

SEQ ID NO: 15142 - DNA, 20 bp, Artificial Sequence
  Description of Artificial Sequence: Synthetic oligonucleotide
  Target: SOD1; (+) strand; PAM type: YTN; PAM sequence: TTC
aaggctagcagtgtactcaa

SEQ ID NO: 15143 - DNA, 20 bp, Artificial Sequence
  Description of Artificial Sequence: Synthetic oligonucleotide
  Target: SOD1; (+) strand; PAM type: YTN; PAM sequence: CTA
gcagtgtactcaacaaggga

SEQ ID NO: 15144 - DNA, 20 bp, Artificial Sequence
  Description of Artificial Sequence: Synthetic oligonucleotide
  Target: SOD1; (+) strand; PAM type: YTN; PAM sequence: CTC
aacaagggacagtccctgtg

SEQ ID NO: 15145 - DNA, 20 bp, Artificial Sequence
  Description of Artificial Sequence: Synthetic oligonucleotide
  Target: SOD1; (+) strand; PAM type: YTN; PAM sequence: CTG
tgtggcctgttcaggatcct

SEQ ID NO: 15146 - DNA, 20 bp, Artificial Sequence
  Description of Artificial Sequence: Synthetic oligonucleotide
  Target: SOD1; (+) strand; PAM type: YTN; PAM sequence: CTG
ttcaggatcctatacacagg

SEQ ID NO: 15147 - DNA, 20 bp, Artificial Sequence
  Description of Artificial Sequence: Synthetic oligonucleotide
  Target: SOD1; (+) strand; PAM type: YTN; PAM sequence: TTC
aggatcctatacacaggctc

SEQ ID NO: 15148 - DNA, 20 bp, Artificial Sequence
  Description of Artificial Sequence: Synthetic oligonucleotide
  Target: SOD1; (+) strand; PAM type: YTN; PAM sequence: CTA
tacacaggctcagggctctt

SEQ ID NO: 15149 - DNA, 20 bp, Artificial Sequence
  Description of Artificial Sequence: Synthetic oligonucleotide
  Target: SOD1; (+) strand; PAM type: YTN; PAM sequence: CTC
agggctctttgggcaggaaa

SEQ ID NO: 15150 - DNA, 20 bp, Artificial Sequence
  Description of Artificial Sequence: Synthetic oligonucleotide
  Target: SOD1; (+) strand; PAM type: YTN; PAM sequence: CTC
tttgggcaggaaattccagg

SEQ ID NO: 15151 - DNA, 20 bp, Artificial Sequence
  Description of Artificial Sequence: Synthetic oligonucleotide
  Target: SOD1; (+) strand; PAM type: YTN; PAM sequence: CTT
tgggcaggaaattccaggat

SEQ ID NO: 15152 - DNA, 20 bp, Artificial Sequence
  Description of Artificial Sequence: Synthetic oligonucleotide
  Target: SOD1; (+) strand; PAM type: YTN; PAM sequence: TTT
gggcaggaaattccaggatc

SEQ ID NO: 15153 - DNA, 20 bp, Artificial Sequence
  Description of Artificial Sequence: Synthetic oligonucleotide
  Target: SOD1; (+) strand; PAM type: YTN; PAM sequence: TTG
ggcaggaaattccaggatcc

SEQ ID NO: 15154 - DNA, 20 bp, Artificial Sequence
  Description of Artificial Sequence: Synthetic oligonucleotide
  Target: SOD1; (+) strand; PAM type: YTN; PAM sequence: TTC
caggatccgggtactcaagt

SEQ ID NO: 15155 - DNA, 20 bp, Artificial Sequence
  Description of Artificial Sequence: Synthetic oligonucleotide
  Target: SOD1; (+) strand; PAM type: YTN; PAM sequence: CTC
aagtggtgttctaaacagtg

SEQ ID NO: 15156 - DNA, 20 bp, Artificial Sequence
  Description of Artificial Sequence: Synthetic oligonucleotide
  Target: SOD1; (+) strand; PAM type: YTN; PAM sequence: TTC
taaacagtggttcttggccg

SEQ ID NO: 15157 - DNA, 20 bp, Artificial Sequence
  Description of Artificial Sequence: Synthetic oligonucleotide
  Target: SOD1; (+) strand; PAM type: YTN; PAM sequence: CTA
aacagtggttcttggccggg

SEQ ID NO: 15158 - DNA, 20 bp, Artificial Sequence
  Description of Artificial Sequence: Synthetic oligonucleotide
  Target: SOD1; (+) strand; PAM type: YTN; PAM sequence: TTC
ttggccgggtgtggtggctc

SEQ ID NO: 15159 - DNA, 20 bp, Artificial Sequence
  Description of Artificial Sequence: Synthetic oligonucleotide
  Target: SOD1; (+) strand; PAM type: YTN; PAM sequence: CTT
ggccgggtgtggtggctcac

SEQ ID NO: 15160 - DNA, 20 bp, Artificial Sequence
  Description of Artificial Sequence: Synthetic oligonucleotide
  Target: SOD1; (+) strand; PAM type: YTN; PAM sequence: TTG
gccgggtgtggtggctcaca

SEQ ID NO: 15161 - DNA, 20 bp, Artificial Sequence
  Description of Artificial Sequence: Synthetic oligonucleotide
  Target: SOD1; (+) strand; PAM type: YTN; PAM sequence: CTC
acacctgtaatcccagcact

SEQ ID NO: 15162 - DNA, 20 bp, Artificial Sequence
  Description of Artificial Sequence: Synthetic oligonucleotide
  Target: SOD1; (+) strand; PAM type: YTN; PAM sequence: CTG
taatcccagcactttgggag

SEQ ID NO: 15163 - DNA, 20 bp, Artificial Sequence
  Description of Artificial Sequence: Synthetic oligonucleotide
  Target: SOD1; (+) strand; PAM type: YTN; PAM sequence: CTT
tgggaggccgaggctggcag

SEQ ID NO: 15164 - DNA, 20 bp, Artificial Sequence
  Description of Artificial Sequence: Synthetic oligonucleotide
  Target: SOD1; (+) strand; PAM type: YTN; PAM sequence: TTT
gggaggccgaggctggcaga

SEQ ID NO: 15165 - DNA, 20 bp, Artificial Sequence
  Description of Artificial Sequence: Synthetic oligonucleotide
  Target: SOD1; (+) strand; PAM type: YTN; PAM sequence: TTG
ggaggccgaggctggcagat

SEQ ID NO: 15166 - DNA, 20 bp, Artificial Sequence
  Description of Artificial Sequence: Synthetic oligonucleotide
  Target: SOD1; (+) strand; PAM type: YTN; PAM sequence: CTG
gcagatcacttgaggtcagg

SEQ ID NO: 15167 - DNA, 20 bp, Artificial Sequence
  Description of Artificial Sequence: Synthetic oligonucleotide
  Target: SOD1; (+) strand; PAM type: YTN; PAM sequence: CTT
gaggtcaggagttcgagacc

SEQ ID NO: 15168 - DNA, 20 bp, Artificial Sequence
  Description of Artificial Sequence: Synthetic oligonucleotide
  Target: SOD1; (+) strand; PAM type: YTN; PAM sequence: TTG
aggtcaggagttcgagacca

SEQ ID NO: 15169 - DNA, 20 bp, Artificial Sequence
  Description of Artificial Sequence: Synthetic oligonucleotide
  Target: SOD1; (+) strand; PAM type: YTN; PAM sequence: TTC
gagaccagcctggccaacat

SEQ ID NO: 15170 - DNA, 20 bp, Artificial Sequence
  Description of Artificial Sequence: Synthetic oligonucleotide
  Target: SOD1; (+) strand; PAM type: YTN; PAM sequence: CTG
gccaacatggtgaaacccca

SEQ ID NO: 15171 - DNA, 20 bp, Artificial Sequence
  Description of Artificial Sequence: Synthetic oligonucleotide
  Target: SOD1; (+) strand; PAM type: YTN; PAM sequence: CTC
tactaaaaatacaaaaactt

SEQ ID NO: 15172 - DNA, 20 bp, Artificial Sequence
  Description of Artificial Sequence: Synthetic oligonucleotide
  Target: SOD1; (+) strand; PAM type: YTN; PAM sequence: CTA
ctaaaaatacaaaaacttag

SEQ ID NO: 15173 - DNA, 20 bp, Artificial Sequence
  Description of Artificial Sequence: Synthetic oligonucleotide
  Target: SOD1; (+) strand; PAM type: YTN; PAM sequence: CTA
aaaatacaaaaacttagcca

SEQ ID NO: 15174 - DNA, 20 bp, Artificial Sequence
  Description of Artificial Sequence: Synthetic oligonucleotide
  Target: SOD1; (+) strand; PAM type: YTN; PAM sequence: CTT
agccaggcatggtgtgcacg

SEQ ID NO: 15175 - DNA, 20 bp, Artificial Sequence
  Description of Artificial Sequence: Synthetic oligonucleotide
  Target: SOD1; (+) strand; PAM type: YTN; PAM sequence: TTA
gccaggcatggtgtgcacgc

SEQ ID NO: 15176 - DNA, 20 bp, Artificial Sequence
  Description of Artificial Sequence: Synthetic oligonucleotide
  Target: SOD1; (+) strand; PAM type: YTN; PAM sequence: CTG
tagtcccagctactcgggag

SEQ ID NO: 15177 - DNA, 20 bp, Artificial Sequence
  Description of Artificial Sequence: Synthetic oligonucleotide
  Target: SOD1; (+) strand; PAM type: YTN; PAM sequence: CTA
ctcgggaggctgaggcagga

SEQ ID NO: 15178 - DNA, 20 bp, Artificial Sequence
  Description of Artificial Sequence: Synthetic oligonucleotide
  Target: SOD1; (+) strand; PAM type: YTN; PAM sequence: CTC
gggaggctgaggcaggagaa

SEQ ID NO: 15179 - DNA, 20 bp, Artificial Sequence
  Description of Artificial Sequence: Synthetic oligonucleotide
  Target: SOD1; (+) strand; PAM type: YTN; PAM sequence: CTG
aggcaggagaatcacttgaa

SEQ ID NO: 15180 - DNA, 20 bp, Artificial Sequence
  Description of Artificial Sequence: Synthetic oligonucleotide
  Target: SOD1; (+) strand; PAM type: YTN; PAM sequence: CTT
gaacccagcaggcggaggtt

SEQ ID NO: 15181 - DNA, 20 bp, Artificial Sequence
  Description of Artificial Sequence: Synthetic oligonucleotide
  Target: SOD1; (+) strand; PAM type: YTN; PAM sequence: TTG
aacccagcaggcggaggttg

SEQ ID NO: 15182 - DNA, 20 bp, Artificial Sequence
  Description of Artificial Sequence: Synthetic oligonucleotide
  Target: SOD1; (+) strand; PAM type: YTN; PAM sequence: TTG
cagtgagctgagattgcacc

SEQ ID NO: 15183 - DNA, 20 bp, Artificial Sequence
  Description of Artificial Sequence: Synthetic oligonucleotide
  Target: SOD1; (+) strand; PAM type: YTN; PAM sequence: CTG
agattgcaccactgcactcc

SEQ ID NO: 15184 - DNA, 20 bp, Artificial Sequence
  Description of Artificial Sequence: Synthetic oligonucleotide
  Target: SOD1; (+) strand; PAM type: YTN; PAM sequence: TTG
caccactgcactccagcctg

SEQ ID NO: 15185 - DNA, 20 bp, Artificial Sequence
  Description of Artificial Sequence: Synthetic oligonucleotide
  Target: SOD1; (+) strand; PAM type: YTN; PAM sequence: CTG
cactccagcctggtgacaga

SEQ ID NO: 15186 - DNA, 20 bp, Artificial Sequence
  Description of Artificial Sequence: Synthetic oligonucleotide
  Target: SOD1; (+) strand; PAM type: YTN; PAM sequence: CTC
cagcctggtgacagagtgag

SEQ ID NO: 15187 - DNA, 20 bp, Artificial Sequence
  Description of Artificial Sequence: Synthetic oligonucleotide
  Target: SOD1; (+) strand; PAM type: YTN; PAM sequence: CTG
gtgacagagtgagactccat

SEQ ID NO: 15188 - DNA, 20 bp, Artificial Sequence
  Description of Artificial Sequence: Synthetic oligonucleotide
  Target: SOD1; (+) strand; PAM type: YTN; PAM sequence: CTC
catatcaaaataaatacata

SEQ ID NO: 15189 - DNA, 20 bp, Artificial Sequence
  Description of Artificial Sequence: Synthetic oligonucleotide
  Target: SOD1; (+) strand; PAM type: YTN; PAM sequence: TTC
ttaactgggagtgatttggc

SEQ ID NO: 15190 - DNA, 20 bp, Artificial Sequence
  Description of Artificial Sequence: Synthetic oligonucleotide
  Target: SOD1; (+) strand; PAM type: YTN; PAM sequence: CTT
aactgggagtgatttggcaa

SEQ ID NO: 15191 - DNA, 20 bp, Artificial Sequence
  Description of Artificial Sequence: Synthetic oligonucleotide
  Target: SOD1; (+) strand; PAM type: YTN; PAM sequence: TTA
actgggagtgatttggcaac

SEQ ID NO: 15192 - DNA, 20 bp, Artificial Sequence
  Description of Artificial Sequence: Synthetic oligonucleotide
  Target: SOD1; (+) strand; PAM type: YTN; PAM sequence: CTG
ggagtgatttggcaacgtct

SEQ ID NO: 15193 - DNA, 20 bp, Artificial Sequence
  Description of Artificial Sequence: Synthetic oligonucleotide
  Target: SOD1; (+) strand; PAM type: YTN; PAM sequence: TTT
ggcaacgtctggaattattt

SEQ ID NO: 15194 - DNA, 20 bp, Artificial Sequence
  Description of Artificial Sequence: Synthetic oligonucleotide
  Target: SOD1; (+) strand; PAM type: YTN; PAM sequence: TTG
gcaacgtctggaattatttt

SEQ ID NO: 15195 - DNA, 20 bp, Artificial Sequence
  Description of Artificial Sequence: Synthetic oligonucleotide
  Target: SOD1; (+) strand; PAM type: YTN; PAM sequence: CTG
gaattatttttggttatccc

SEQ ID NO: 15196 - DNA, 20 bp, Artificial Sequence
  Description of Artificial Sequence: Synthetic oligonucleotide
  Target: SOD1; (+) strand; PAM type: YTN; PAM sequence: TTA
tttttggttatcccagcctg

SEQ ID NO: 15197 - DNA, 20 bp, Artificial Sequence
  Description of Artificial Sequence: Synthetic oligonucleotide
  Target: SOD1; (+) strand; PAM type: YTN; PAM sequence: TTT
ttggttatcccagcctggca

SEQ ID NO: 15198 - DNA, 20 bp, Artificial Sequence
  Description of Artificial Sequence: Synthetic oligonucleotide
  Target: SOD1; (+) strand; PAM type: YTN; PAM sequence: TTT
tggttatcccagcctggcag

SEQ ID NO: 15199 - DNA, 20 bp, Artificial Sequence
  Description of Artificial Sequence: Synthetic oligonucleotide
  Target: SOD1; (+) strand; PAM type: YTN; PAM sequence: TTT
ggttatcccagcctggcagg

SEQ ID NO: 15200 - DNA, 20 bp, Artificial Sequence
  Description of Artificial Sequence: Synthetic oligonucleotide
  Target: SOD1; (+) strand; PAM type: YTN; PAM sequence: TTG
gttatcccagcctggcaggg

SEQ ID NO: 15201 - DNA, 20 bp, Artificial Sequence
  Description of Artificial Sequence: Synthetic oligonucleotide
  Target: SOD1; (+) strand; PAM type: YTN; PAM sequence: TTA
tcccagcctggcagggaggg

SEQ ID NO: 15202 - DNA, 20 bp, Artificial Sequence
  Description of Artificial Sequence: Synthetic oligonucleotide
  Target: SOD1; (+) strand; PAM type: YTN; PAM sequence: CTG
gcagggagggacagggtatt

SEQ ID NO: 15203 - DNA, 20 bp, Artificial Sequence
  Description of Artificial Sequence: Synthetic oligonucleotide
  Target: SOD1; (+) strand; PAM type: YTN; PAM sequence: TTA
ctggcatctagtgagtaggg

SEQ ID NO: 15204 - DNA, 20 bp, Artificial Sequence
  Description of Artificial Sequence: Synthetic oligonucleotide
  Target: SOD1; (+) strand; PAM type: YTN; PAM sequence: CTG
gcatctagtgagtaggggct

SEQ ID NO: 15205 - DNA, 20 bp, Artificial Sequence
  Description of Artificial Sequence: Synthetic oligonucleotide
  Target: SOD1; (+) strand; PAM type: YTN; PAM sequence: CTA
gtgagtaggggctagggatt

SEQ ID NO: 15206 - DNA, 20 bp, Artificial Sequence
  Description of Artificial Sequence: Synthetic oligonucleotide
  Target: SOD1; (+) strand; PAM type: YTN; PAM sequence: CTA
gggattctactgaacatcct

SEQ ID NO: 15207 - DNA, 20 bp, Artificial Sequence
  Description of Artificial Sequence: Synthetic oligonucleotide
  Target: SOD1; (+) strand; PAM type: YTN; PAM sequence: TTC
tactgaacatcctacagtgt

SEQ ID NO: 15208 - DNA, 20 bp, Artificial Sequence
  Description of Artificial Sequence: Synthetic oligonucleotide
  Target: SOD1; (+) strand; PAM type: YTN; PAM sequence: CTA
ctgaacatcctacagtgtac

SEQ ID NO: 15209 - DNA, 20 bp, Artificial Sequence
  Description of Artificial Sequence: Synthetic oligonucleotide
  Target: SOD1; (+) strand; PAM type: YTN; PAM sequence: CTG
aacatcctacagtgtacagg

SEQ ID NO: 15210 - DNA, 20 bp, Artificial Sequence
  Description of Artificial Sequence: Synthetic oligonucleotide
  Target: SOD1; (+) strand; PAM type: YTN; PAM sequence: CTA
cagtgtacaggacagcctcc

SEQ ID NO: 15211 - DNA, 20 bp, Artificial Sequence
  Description of Artificial Sequence: Synthetic oligonucleotide
  Target: SOD1; (+) strand; PAM type: YTN; PAM sequence: CTC
cacagcaaagaactgtctgg

SEQ ID NO: 15212 - DNA, 20 bp, Artificial Sequence
  Description of Artificial Sequence: Synthetic oligonucleotide
  Target: SOD1; (+) strand; PAM type: YTN; PAM sequence: CTG
tctggcccaaaatgtccata

SEQ ID NO: 15213 - DNA, 20 bp, Artificial Sequence
  Description of Artificial Sequence: Synthetic oligonucleotide
  Target: SOD1; (+) strand; PAM type: YTN; PAM sequence: CTG
gcccaaaatgtccatagtgc

SEQ ID NO: 15214 - DNA, 20 bp, Artificial Sequence
  Description of Artificial Sequence: Synthetic oligonucleotide
  Target: SOD1; (+) strand; PAM type: YTN; PAM sequence: TTC
gatgccctgcattaggaaga

SEQ ID NO: 15215 - DNA, 20 bp, Artificial Sequence
  Description of Artificial Sequence: Synthetic oligonucleotide
  Target: SOD1; (+) strand; PAM type: YTN; PAM sequence: CTG
cattaggaagatataaatac

SEQ ID NO: 15216 - DNA, 20 bp, Artificial Sequence
  Description of Artificial Sequence: Synthetic oligonucleotide
  Target: SOD1; (+) strand; PAM type: YTN; PAM sequence: TTA
ggaagatataaatactctta

SEQ ID NO: 15217 - DNA, 20 bp, Artificial Sequence
  Description of Artificial Sequence: Synthetic oligonucleotide
  Target: SOD1; (+) strand; PAM type: YTN; PAM sequence: CTC
ttaaatatcacagagttaaa

SEQ ID NO: 15218 - DNA, 20 bp, Artificial Sequence
  Description of Artificial Sequence: Synthetic oligonucleotide
  Target: SOD1; (+) strand; PAM type: YTN; PAM sequence: CTT
aaatatcacagagttaaatt

SEQ ID NO: 15219 - DNA, 20 bp, Artificial Sequence
  Description of Artificial Sequence: Synthetic oligonucleotide
  Target: SOD1; (+) strand; PAM type: YTN; PAM sequence: TTA
aatatcacagagttaaattc

SEQ ID NO: 15220 - DNA, 20 bp, Artificial Sequence
  Description of Artificial Sequence: Synthetic oligonucleotide
  Target: SOD1; (+) strand; PAM type: YTN; PAM sequence: TTA
aattccttacccctgttcta

SEQ ID NO: 15221 - DNA, 20 bp, Artificial Sequence
  Description of Artificial Sequence: Synthetic oligonucleotide
  Target: SOD1; (+) strand; PAM type: YTN; PAM sequence: TTC
cttacccctgttctagcaga

SEQ ID NO: 15222 - DNA, 20 bp, Artificial Sequence
  Description of Artificial Sequence: Synthetic oligonucleotide
  Target: SOD1; (+) strand; PAM type: YTN; PAM sequence: CTT
acccctgttctagcagagat

SEQ ID NO: 15223 - DNA, 20 bp, Artificial Sequence
  Description of Artificial Sequence: Synthetic oligonucleotide
  Target: SOD1; (+) strand; PAM type: YTN; PAM sequence: TTA
cccctgttctagcagagatg

SEQ ID NO: 15224 - DNA, 20 bp, Artificial Sequence
  Description of Artificial Sequence: Synthetic oligonucleotide
  Target: SOD1; (+) strand; PAM type: YTN; PAM sequence: CTG
ttctagcagagatgatattc

SEQ ID NO: 15225 - DNA, 20 bp, Artificial Sequence
  Description of Artificial Sequence: Synthetic oligonucleotide
  Target: SOD1; (+) strand; PAM type: YTN; PAM sequence: TTC
tagcagagatgatattcttg

SEQ ID NO: 15226 - DNA, 20 bp, Artificial Sequence
  Description of Artificial Sequence: Synthetic oligonucleotide
  Target: SOD1; (+) strand; PAM type: YTN; PAM sequence: CTA
gcagagatgatattcttgcg

SEQ ID NO: 15227 - DNA, 20 bp, Artificial Sequence
  Description of Artificial Sequence: Synthetic oligonucleotide
  Target: SOD1; (+) strand; PAM type: YTN; PAM sequence: TTC
ttgcggggggagcatcttct

SEQ ID NO: 15228 - DNA, 20 bp, Artificial Sequence
  Description of Artificial Sequence: Synthetic oligonucleotide
  Target: SOD1; (+) strand; PAM type: YTN; PAM sequence: CTT
gcggggggagcatcttcttg

SEQ ID NO: 15229 - DNA, 20 bp, Artificial Sequence
  Description of Artificial Sequence: Synthetic oligonucleotide
  Target: SOD1; (+) strand; PAM type: YTN; PAM sequence: TTG
cggggggagcatcttcttgg

SEQ ID NO: 15230 - DNA, 20 bp, Artificial Sequence
  Description of Artificial Sequence: Synthetic oligonucleotide
  Target: SOD1; (+) strand; PAM type: YTN; PAM sequence: CTT
cttggcttcaacacattctt

SEQ ID NO: 15231 - DNA, 20 bp, Artificial Sequence
  Description of Artificial Sequence: Synthetic oligonucleotide
  Target: SOD1; (+) strand; PAM type: YTN; PAM sequence: TTC
ttggcttcaacacattcttt

SEQ ID NO: 15232 - DNA, 20 bp, Artificial Sequence
  Description of Artificial Sequence: Synthetic oligonucleotide
  Target: SOD1; (+) strand; PAM type: YTN; PAM sequence: CTT
ggcttcaacacattcttttc

SEQ ID NO: 15233 - DNA, 20 bp, Artificial Sequence
  Description of Artificial Sequence: Synthetic oligonucleotide
  Target: SOD1; (+) strand; PAM type: YTN; PAM sequence: TTG
gcttcaacacattcttttct

SEQ ID NO: 15234 - DNA, 20 bp, Artificial Sequence
  Description of Artificial Sequence: Synthetic oligonucleotide
  Target: SOD1; (+) strand; PAM type: YTN; PAM sequence: CTT
caacacattcttttctccat

SEQ ID NO: 15235 - DNA, 20 bp, Artificial Sequence
  Description of Artificial Sequence: Synthetic oligonucleotide
  Target: SOD1; (+) strand; PAM type: YTN; PAM sequence: TTC
aacacattcttttctccatg

SEQ ID NO: 15236 - DNA, 20 bp, Artificial Sequence
  Description of Artificial Sequence: Synthetic oligonucleotide
  Target: SOD1; (+) strand; PAM type: YTN; PAM sequence: TTC
ttttctccatgggagatgat

SEQ ID NO: 15237 - DNA, 20 bp, Artificial Sequence
  Description of Artificial Sequence: Synthetic oligonucleotide
  Target: SOD1; (+) strand; PAM type: YTN; PAM sequence: CTT
ttctccatgggagatgatgc

SEQ ID NO: 15238 - DNA, 20 bp, Artificial Sequence
  Description of Artificial Sequence: Synthetic oligonucleotide
  Target: SOD1; (+) strand; PAM type: YTN; PAM sequence: TTT
tctccatgggagatgatgcc

SEQ ID NO: 15239 - DNA, 20 bp, Artificial Sequence
  Description of Artificial Sequence: Synthetic oligonucleotide
  Target: SOD1; (+) strand; PAM type: YTN; PAM sequence: TTT
ctccatgggagatgatgcca

SEQ ID NO: 15240 - DNA, 20 bp, Artificial Sequence
  Description of Artificial Sequence: Synthetic oligonucleotide
  Target: SOD1; (+) strand; PAM type: YTN; PAM sequence: TTC
tccatgggagatgatgccag

SEQ ID NO: 15241 - DNA, 20 bp, Artificial Sequence
  Description of Artificial Sequence: Synthetic oligonucleotide
  Target: SOD1; (+) strand; PAM type: YTN; PAM sequence: CTC
catgggagatgatgccagaa

SEQ ID NO: 15242 - DNA, 20 bp, Artificial Sequence
  Description of Artificial Sequence: Synthetic oligonucleotide
  Target: SOD1; (+) strand; PAM type: YTN; PAM sequence: CTG
gggccagggacccccttgtt

SEQ ID NO: 15243 - DNA, 20 bp, Artificial Sequence
  Description of Artificial Sequence: Synthetic oligonucleotide
  Target: SOD1; (+) strand; PAM type: YTN; PAM sequence: CTT
gttcaggtgtgacgaccatc

SEQ ID NO: 15244 - DNA, 20 bp, Artificial Sequence
  Description of Artificial Sequence: Synthetic oligonucleotide
  Target: SOD1; (+) strand; PAM type: YTN; PAM sequence: TTG
ttcaggtgtgacgaccatcc

SEQ ID NO: 15245 - DNA, 20 bp, Artificial Sequence
  Description of Artificial Sequence: Synthetic oligonucleotide
  Target: SOD1; (+) strand; PAM type: YTN; PAM sequence: TTC
aggtgtgacgaccatcctac

SEQ ID NO: 15246 - DNA, 20 bp, Artificial Sequence
  Description of Artificial Sequence: Synthetic oligonucleotide
  Target: SOD1; (+) strand; PAM type: YTN; PAM sequence: CTA
cgaaggcaccacccaggcat

SEQ ID NO: 15247 - DNA, 20 bp, Artificial Sequence
  Description of Artificial Sequence: Synthetic oligonucleotide
  Target: SOD1; (+) strand; PAM type: YTN; PAM sequence: TTA
gaccgtctcaaaagaagagt

SEQ ID NO: 15248 - DNA, 20 bp, Artificial Sequence
  Description of Artificial Sequence: Synthetic oligonucleotide
  Target: SOD1; (+) strand; PAM type: YTN; PAM sequence: CTC
aaaagaagagtaattcactg

SEQ ID NO: 15249 - DNA, 20 bp, Artificial Sequence
  Description of Artificial Sequence: Synthetic oligonucleotide
  Target: SOD1; (+) strand; PAM type: YTN; PAM sequence: TTC
actgtcccaaagcagctctc

SEQ ID NO: 15250 - DNA, 20 bp, Artificial Sequence
  Description of Artificial Sequence: Synthetic oligonucleotide
  Target: SOD1; (+) strand; PAM type: YTN; PAM sequence: CTG
tcccaaagcagctctctcgt

SEQ ID NO: 15251 - DNA, 20 bp, Artificial Sequence
  Description of Artificial Sequence: Synthetic oligonucleotide
  Target: SOD1; (+) strand; PAM type: YTN; PAM sequence: CTC
tctcgtgtctgtgggcggat

SEQ ID NO: 15252 - DNA, 20 bp, Artificial Sequence
  Description of Artificial Sequence: Synthetic oligonucleotide
  Target: SOD1; (+) strand; PAM type: YTN; PAM sequence: CTC
tcgtgtctgtgggcggatcc

SEQ ID NO: 15253 - DNA, 20 bp, Artificial Sequence
  Description of Artificial Sequence: Synthetic oligonucleotide
  Target: SOD1; (+) strand; PAM type: YTN; PAM sequence: CTC
gtgtctgtgggcggatccct

SEQ ID NO: 15254 - DNA, 20 bp, Artificial Sequence
  Description of Artificial Sequence: Synthetic oligonucleotide
  Target: SOD1; (+) strand; PAM type: YTN; PAM sequence: CTG
tgggcggatcccttggcaag

SEQ ID NO: 15255 - DNA, 20 bp, Artificial Sequence
  Description of Artificial Sequence: Synthetic oligonucleotide
  Target: SOD1; (+) strand; PAM type: YTN; PAM sequence: CTT
ggcaagtttacaatgaactg

SEQ ID NO: 15256 - DNA, 20 bp, Artificial Sequence
  Description of Artificial Sequence: Synthetic oligonucleotide
  Target: SOD1; (+) strand; PAM type: YTN; PAM sequence: TTG
gcaagtttacaatgaactga

SEQ ID NO: 15257 - DNA, 20 bp, Artificial Sequence
  Description of Artificial Sequence: Synthetic oligonucleotide
  Target: SOD1; (+) strand; PAM type: YTN; PAM sequence: TTT
acaatgaactgaaatctgcc

SEQ ID NO: 15258 - DNA, 20 bp, Artificial Sequence
  Description of Artificial Sequence: Synthetic oligonucleotide
  Target: SOD1; (+) strand; PAM type: YTN; PAM sequence: TTA
caatgaactgaaatctgccg

SEQ ID NO: 15259 - DNA, 20 bp, Artificial Sequence
  Description of Artificial Sequence: Synthetic oligonucleotide
  Target: SOD1; (+) strand; PAM type: YTN; PAM sequence: CTG
aaatctgccgaacttcctgg

SEQ ID NO: 15260 - DNA, 20 bp, Artificial Sequence
  Description of Artificial Sequence: Synthetic oligonucleotide
  Target: SOD1; (+) strand; PAM type: YTN; PAM sequence: CTG
ccgaacttcctggaacccaa

SEQ ID NO: 15261 - DNA, 20 bp, Artificial Sequence
  Description of Artificial Sequence: Synthetic oligonucleotide
  Target: SOD1; (+) strand; PAM type: YTN; PAM sequence: CTT
cctggaacccaaagaaactt

SEQ ID NO: 15262 - DNA, 20 bp, Artificial Sequence
  Description of Artificial Sequence: Synthetic oligonucleotide
  Target: SOD1; (+) strand; PAM type: YTN; PAM sequence: TTC
ctggaacccaaagaaacttt

SEQ ID NO: 15263 - DNA, 20 bp, Artificial Sequence
  Description of Artificial Sequence: Synthetic oligonucleotide
  Target: SOD1; (+) strand; PAM type: YTN; PAM sequence: CTG
gaacccaaagaaactttagc

SEQ ID NO: 15264 - DNA, 20 bp, Artificial Sequence
  Description of Artificial Sequence: Synthetic oligonucleotide
  Target: SOD1; (+) strand; PAM type: YTN; PAM sequence: CTT
tagccttgggcaaaggccct

SEQ ID NO: 15265 - DNA, 20 bp, Artificial Sequence
  Description of Artificial Sequence: Synthetic oligonucleotide
  Target: SOD1; (+) strand; PAM type: YTN; PAM sequence: TTT
agccttgggcaaaggccctt

SEQ ID NO: 15266 - DNA, 20 bp, Artificial Sequence
  Description of Artificial Sequence: Synthetic oligonucleotide
  Target: SOD1; (+) strand; PAM type: YTN; PAM sequence: TTA
gccttgggcaaaggcccttt

SEQ ID NO: 15267 - DNA, 20 bp, Artificial Sequence
  Description of Artificial Sequence: Synthetic oligonucleotide
  Target: SOD1; (+) strand; PAM type: YTN; PAM sequence: CTT
gggcaaaggccctttggcca

SEQ ID NO: 15268 - DNA, 20 bp, Artificial Sequence
  Description of Artificial Sequence: Synthetic oligonucleotide
  Target: SOD1; (+) strand; PAM type: YTN; PAM sequence: TTG
ggcaaaggccctttggccag

SEQ ID NO: 15269 - DNA, 20 bp, Artificial Sequence
  Description of Artificial Sequence: Synthetic oligonucleotide
  Target: SOD1; (+) strand; PAM type: YTN; PAM sequence: CTT
tggccagcatttgcactgtt

SEQ ID NO: 15270 - DNA, 20 bp, Artificial Sequence
  Description of Artificial Sequence: Synthetic oligonucleotide
  Target: SOD1; (+) strand; PAM type: YTN; PAM sequence: TTT
ggccagcatttgcactgttt

SEQ ID NO: 15271 - DNA, 20 bp, Artificial Sequence
  Description of Artificial Sequence: Synthetic oligonucleotide
  Target: SOD1; (+) strand; PAM type: YTN; PAM sequence: TTG
gccagcatttgcactgttta

SEQ ID NO: 15272 - DNA, 20 bp, Artificial Sequence
  Description of Artificial Sequence: Synthetic oligonucleotide
  Target: SOD1; (+) strand; PAM type: YTN; PAM sequence: TTT
gcactgtttatgcaaccgtt

SEQ ID NO: 15273 - DNA, 20 bp, Artificial Sequence
  Description of Artificial Sequence: Synthetic oligonucleotide
  Target: SOD1; (+) strand; PAM type: YTN; PAM sequence: TTG
cactgtttatgcaaccgttt

SEQ ID NO: 15274 - DNA, 20 bp, Artificial Sequence
  Description of Artificial Sequence: Synthetic oligonucleotide
  Target: SOD1; (+) strand; PAM type: YTN; PAM sequence: CTG
tttatgcaaccgtttagaat

SEQ ID NO: 15275 - DNA, 20 bp, Artificial Sequence
  Description of Artificial Sequence: Synthetic oligonucleotide
  Target: SOD1; (+) strand; PAM type: YTN; PAM sequence: TTT
atgcaaccgtttagaatata

SEQ ID NO: 15276 - DNA, 20 bp, Artificial Sequence
  Description of Artificial Sequence: Synthetic oligonucleotide
  Target: SOD1; (+) strand; PAM type: YTN; PAM sequence: TTA
tgcaaccgtttagaatatac

SEQ ID NO: 15277 - DNA, 20 bp, Artificial Sequence
  Description of Artificial Sequence: Synthetic oligonucleotide
  Target: SOD1; (+) strand; PAM type: YTN; PAM sequence: TTT
agaatatacgaattatctgg

SEQ ID NO: 15278 - DNA, 20 bp, Artificial Sequence
  Description of Artificial Sequence: Synthetic oligonucleotide
  Target: SOD1; (+) strand; PAM type: YTN; PAM sequence: TTA
gaatatacgaattatctgga

SEQ ID NO: 15279 - DNA, 20 bp, Artificial Sequence
  Description of Artificial Sequence: Synthetic oligonucleotide
  Target: SOD1; (+) strand; PAM type: YTN; PAM sequence: TTA
tctggagactactaccaaat

SEQ ID NO: 15280 - DNA, 20 bp, Artificial Sequence
  Description of Artificial Sequence: Synthetic oligonucleotide
  Target: SOD1; (+) strand; PAM type: YTN; PAM sequence: CTG
gagactactaccaaatacaa

SEQ ID NO: 15281 - DNA, 20 bp, Artificial Sequence
  Description of Artificial Sequence: Synthetic oligonucleotide
  Target: SOD1; (+) strand; PAM type: YTN; PAM sequence: CTA
ctaccaaatacaacaggcaa

SEQ ID NO: 15282 - DNA, 20 bp, Artificial Sequence
  Description of Artificial Sequence: Synthetic oligonucleotide
  Target: SOD1; (+) strand; PAM type: YTN; PAM sequence: CTA
ccaaatacaacaggcaaaac

SEQ ID NO: 15283 - DNA, 20 bp, Artificial Sequence
  Description of Artificial Sequence: Synthetic oligonucleotide
  Target: SOD1; (+) strand; PAM type: YTN; PAM sequence: CTG
caaatatgtatacttcctag

SEQ ID NO: 15284 - DNA, 20 bp, Artificial Sequence
  Description of Artificial Sequence: Synthetic oligonucleotide
  Target: SOD1; (+) strand; PAM type: YTN; PAM sequence: CTT
cctagaggatgataaaaaaa

SEQ ID NO: 15285 - DNA, 20 bp, Artificial Sequence
  Description of Artificial Sequence: Synthetic oligonucleotide
  Target: SOD1; (+) strand; PAM type: YTN; PAM sequence: TTC
ctagaggatgataaaaaaat

SEQ ID NO: 15286 - DNA, 20 bp, Artificial Sequence
  Description of Artificial Sequence: Synthetic oligonucleotide
  Target: SOD1; (+) strand; PAM type: YTN; PAM sequence: CTA
gaggatgataaaaaaatgtg

SEQ ID NO: 15287 - DNA, 20 bp, Artificial Sequence
  Description of Artificial Sequence: Synthetic oligonucleotide
  Target: SOD1; (+) strand; PAM type: YTN; PAM sequence: TTG
tatttctctgatagaggatg

SEQ ID NO: 15288 - DNA, 20 bp, Artificial Sequence
  Description of Artificial Sequence: Synthetic oligonucleotide
  Target: SOD1; (+) strand; PAM type: YTN; PAM sequence: TTT
ctctgatagaggatgcatta

SEQ ID NO: 15289 - DNA, 20 bp, Artificial Sequence
  Description of Artificial Sequence: Synthetic oligonucleotide
  Target: SOD1; (+) strand; PAM type: YTN; PAM sequence: TTC
tctgatagaggatgcattag

SEQ ID NO: 15290 - DNA, 20 bp, Artificial Sequence
  Description of Artificial Sequence: Synthetic oligonucleotide
  Target: SOD1; (+) strand; PAM type: YTN; PAM sequence: CTC
tgatagaggatgcattagag

SEQ ID NO: 15291 - DNA, 20 bp, Artificial Sequence
  Description of Artificial Sequence: Synthetic oligonucleotide
  Target: SOD1; (+) strand; PAM type: YTN; PAM sequence: CTG
atagaggatgcattagagtc

SEQ ID NO: 15292 - DNA, 20 bp, Artificial Sequence
  Description of Artificial Sequence: Synthetic oligonucleotide
  Target: SOD1; (+) strand; PAM type: YTN; PAM sequence: TTA
gagtctgagggtctaaatag

SEQ ID NO: 15293 - DNA, 20 bp, Artificial Sequence
  Description of Artificial Sequence: Synthetic oligonucleotide
  Target: SOD1; (+) strand; PAM type: YTN; PAM sequence: CTG
agggtctaaatagcgtaaat

SEQ ID NO: 15294 - DNA, 20 bp, Artificial Sequence
  Description of Artificial Sequence: Synthetic oligonucleotide
  Target: SOD1; (+) strand; PAM type: YTN; PAM sequence: CTA
aatagcgtaaataataaata

SEQ ID NO: 15295 - DNA, 20 bp, Artificial Sequence
  Description of Artificial Sequence: Synthetic oligonucleotide
  Target: SOD1; (+) strand; PAM type: YTN; PAM sequence: CTC
caaacgaggctggaatagct

SEQ ID NO: 15296 - DNA, 20 bp, Artificial Sequence
  Description of Artificial Sequence: Synthetic oligonucleotide
  Target: SOD1; (+) strand; PAM type: YTN; PAM sequence: CTG
gaatagcttctattgttgtt

SEQ ID NO: 15297 - DNA, 20 bp, Artificial Sequence
  Description of Artificial Sequence: Synthetic oligonucleotide
  Target: SOD1; (+) strand; PAM type: YTN; PAM sequence: CTT
ctattgttgtttcacactgg

SEQ ID NO: 15298 - DNA, 20 bp, Artificial Sequence
  Description of Artificial Sequence: Synthetic oligonucleotide
  Target: SOD1; (+) strand; PAM type: YTN; PAM sequence: TTC
tattgttgtttcacactgga

SEQ ID NO: 15299 - DNA, 20 bp, Artificial Sequence
  Description of Artificial Sequence: Synthetic oligonucleotide
  Target: SOD1; (+) strand; PAM type: YTN; PAM sequence: CTA
ttgttgtttcacactggact

SEQ ID NO: 15300 - DNA, 20 bp, Artificial Sequence
  Description of Artificial Sequence: Synthetic oligonucleotide
  Target: SOD1; (+) strand; PAM type: YTN; PAM sequence: TTG
ttgtttcacactggacttca

SEQ ID NO: 15301 - DNA, 20 bp, Artificial Sequence
  Description of Artificial Sequence: Synthetic oligonucleotide
  Target: SOD1; (+) strand; PAM type: YTN; PAM sequence: TTG
tttcacactggacttcaatt

SEQ ID NO: 15302 - DNA, 20 bp, Artificial Sequence
  Description of Artificial Sequence: Synthetic oligonucleotide
  Target: SOD1; (+) strand; PAM type: YTN; PAM sequence: TTT
cacactggacttcaattaag

SEQ ID NO: 15303 - DNA, 20 bp, Artificial Sequence
  Description of Artificial Sequence: Synthetic oligonucleotide
  Target: SOD1; (+) strand; PAM type: YTN; PAM sequence: TTC
acactggacttcaattaagt

SEQ ID NO: 15304 - DNA, 20 bp, Artificial Sequence
  Description of Artificial Sequence: Synthetic oligonucleotide
  Target: SOD1; (+) strand; PAM type: YTN; PAM sequence: CTG
gacttcaattaagtctcagt

SEQ ID NO: 15305 - DNA, 20 bp, Artificial Sequence
  Description of Artificial Sequence: Synthetic oligonucleotide
  Target: SOD1; (+) strand; PAM type: YTN; PAM sequence: CTT
caattaagtctcagtatttt

SEQ ID NO: 15306 - DNA, 20 bp, Artificial Sequence
  Description of Artificial Sequence: Synthetic oligonucleotide
  Target: SOD1; (+) strand; PAM type: YTN; PAM sequence: TTC
aattaagtctcagtattttg

SEQ ID NO: 15307 - DNA, 20 bp, Artificial Sequence
  Description of Artificial Sequence: Synthetic oligonucleotide
  Target: SOD1; (+) strand; PAM type: YTN; PAM sequence: TTA
agtctcagtattttgccata

SEQ ID NO: 15308 - DNA, 20 bp, Artificial Sequence
  Description of Artificial Sequence: Synthetic oligonucleotide
  Target: SOD1; (+) strand; PAM type: YTN; PAM sequence: CTC
agtattttgccatactcaat

SEQ ID NO: 15309 - DNA, 20 bp, Artificial Sequence
  Description of Artificial Sequence: Synthetic oligonucleotide
  Target: SOD1; (+) strand; PAM type: YTN; PAM sequence: TTT
tgccatactcaatattaagt

SEQ ID NO: 15310 - DNA, 20 bp, Artificial Sequence
  Description of Artificial Sequence: Synthetic oligonucleotide
  Target: SOD1; (+) strand; PAM type: YTN; PAM sequence: TTT
gccatactcaatattaagta

SEQ ID NO: 15311 - DNA, 20 bp, Artificial Sequence
  Description of Artificial Sequence: Synthetic oligonucleotide
  Target: SOD1; (+) strand; PAM type: YTN; PAM sequence: TTG
ccatactcaatattaagtac

SEQ ID NO: 15312 - DNA, 20 bp, Artificial Sequence
  Description of Artificial Sequence: Synthetic oligonucleotide
  Target: SOD1; (+) strand; PAM type: YTN; PAM sequence: CTC
aatattaagtactaggctgg

SEQ ID NO: 15313 - DNA, 20 bp, Artificial Sequence
  Description of Artificial Sequence: Synthetic oligonucleotide
  Target: SOD1; (+) strand; PAM type: YTN; PAM sequence: TTA
agtactaggctggacgtggt

SEQ ID NO: 15314 - DNA, 20 bp, Artificial Sequence
  Description of Artificial Sequence: Synthetic oligonucleotide
  Target: SOD1; (+) strand; PAM type: YTN; PAM sequence: CTA
ggctggacgtggtggctcat

SEQ ID NO: 15315 - DNA, 20 bp, Artificial Sequence
  Description of Artificial Sequence: Synthetic oligonucleotide
  Target: SOD1; (+) strand; PAM type: YTN; PAM sequence: CTG
gacgtggtggctcatgtctg

SEQ ID NO: 15316 - DNA, 20 bp, Artificial Sequence
  Description of Artificial Sequence: Synthetic oligonucleotide
  Target: SOD1; (+) strand; PAM type: YTN; PAM sequence: CTC
atgtctgtaatcccagcact

SEQ ID NO: 15317 - DNA, 20 bp, Artificial Sequence
  Description of Artificial Sequence: Synthetic oligonucleotide
  Target: SOD1; (+) strand; PAM type: YTN; PAM sequence: CTG
taatcccagcactttgggag

SEQ ID NO: 15318 - DNA, 20 bp, Artificial Sequence
  Description of Artificial Sequence: Synthetic oligonucleotide
  Target: SOD1; (+) strand; PAM type: YTN; PAM sequence: CTT
tgggaggccgaggtgggtag

SEQ ID NO: 15319 - DNA, 20 bp, Artificial Sequence
  Description of Artificial Sequence: Synthetic oligonucleotide
  Target: SOD1; (+) strand; PAM type: YTN; PAM sequence: TTT
gggaggccgaggtgggtaga

SEQ ID NO: 15320 - DNA, 20 bp, Artificial Sequence
  Description of Artificial Sequence: Synthetic oligonucleotide
  Target: SOD1; (+) strand; PAM type: YTN; PAM sequence: TTG
ggaggccgaggtgggtagat

SEQ ID NO: 15321 - DNA, 20 bp, Artificial Sequence
  Description of Artificial Sequence: Synthetic oligonucleotide
  Target: SOD1; (+) strand; PAM type: YTN; PAM sequence: CTG
gcttgagctcaggagtttga

SEQ ID NO: 15322 - DNA, 20 bp, Artificial Sequence
  Description of Artificial Sequence: Synthetic oligonucleotide
  Target: SOD1; (+) strand; PAM type: YTN; PAM sequence: CTT
gagctcaggagtttgaaacc

SEQ ID NO: 15323 - DNA, 20 bp, Artificial Sequence
  Description of Artificial Sequence: Synthetic oligonucleotide
  Target: SOD1; (+) strand; PAM type: YTN; PAM sequence: TTG
agctcaggagtttgaaacca

SEQ ID NO: 15324 - DNA, 20 bp, Artificial Sequence
  Description of Artificial Sequence: Synthetic oligonucleotide
  Target: SOD1; (+) strand; PAM type: YTN; PAM sequence: CTC
aggagtttgaaaccagcctg

SEQ ID NO: 15325 - DNA, 20 bp, Artificial Sequence
  Description of Artificial Sequence: Synthetic oligonucleotide
  Target: SOD1; (+) strand; PAM type: YTN; PAM sequence: TTT
gaaaccagcctgggcaacat

SEQ ID NO: 15326 - DNA, 20 bp, Artificial Sequence
  Description of Artificial Sequence: Synthetic oligonucleotide
  Target: SOD1; (+) strand; PAM type: YTN; PAM sequence: TTG
aaaccagcctgggcaacatg

SEQ ID NO: 15327 - DNA, 20 bp, Artificial Sequence
  Description of Artificial Sequence: Synthetic oligonucleotide
  Target: SOD1; (+) strand; PAM type: YTN; PAM sequence: CTG
ggcaacatggtaaaacccca

SEQ ID NO: 15328 - DNA, 20 bp, Artificial Sequence
  Description of Artificial Sequence: Synthetic oligonucleotide
  Target: SOD1; (+) strand; PAM type: YTN; PAM sequence: CTG
tacccaaaatacaaaaatca

SEQ ID NO: 15329 - DNA, 20 bp, Artificial Sequence
  Description of Artificial Sequence: Synthetic oligonucleotide
  Target: SOD1; (+) strand; PAM type: YTN; PAM sequence: CTG
tggtcccaggtacttgggag

SEQ ID NO: 15330 - DNA, 20 bp, Artificial Sequence
  Description of Artificial Sequence: Synthetic oligonucleotide
  Target: SOD1; (+) strand; PAM type: YTN; PAM sequence: CTT
gggaggctgaggcaggagga

SEQ ID NO: 15331 - DNA, 20 bp, Artificial Sequence
  Description of Artificial Sequence: Synthetic oligonucleotide
  Target: SOD1; (+) strand; PAM type: YTN; PAM sequence: TTG
ggaggctgaggcaggaggat

SEQ ID NO: 15332 - DNA, 20 bp, Artificial Sequence
  Description of Artificial Sequence: Synthetic oligonucleotide
  Target: SOD1; (+) strand; PAM type: YTN; PAM sequence: CTG
aggcaggaggatggcttgaa

SEQ ID NO: 15333 - DNA, 20 bp, Artificial Sequence
  Description of Artificial Sequence: Synthetic oligonucleotide
  Target: SOD1; (+) strand; PAM type: YTN; PAM sequence: CTT
gaacccaggaggtggaggct

SEQ ID NO: 15334 - DNA, 20 bp, Artificial Sequence
  Description of Artificial Sequence: Synthetic oligonucleotide
  Target: SOD1; (+) strand; PAM type: YTN; PAM sequence: TTG
aacccaggaggtggaggctg

SEQ ID NO: 15335 - DNA, 20 bp, Artificial Sequence
  Description of Artificial Sequence: Synthetic oligonucleotide
  Target: SOD1; (+) strand; PAM type: YTN; PAM sequence: CTG
cagtgagctatgatggcgcc

SEQ ID NO: 15336 - DNA, 20 bp, Artificial Sequence
  Description of Artificial Sequence: Synthetic oligonucleotide
  Target: SOD1; (+) strand; PAM type: YTN; PAM sequence: CTA
tgatggcgccactgcactcc

SEQ ID NO: 15337 - DNA, 20 bp, Artificial Sequence
  Description of Artificial Sequence: Synthetic oligonucleotide
  Target: SOD1; (+) strand; PAM type: YTN; PAM sequence: CTG
cactccagcctgggtgacag

SEQ ID NO: 15338 - DNA, 20 bp, Artificial Sequence
  Description of Artificial Sequence: Synthetic oligonucleotide
  Target: SOD1; (+) strand; PAM type: YTN; PAM sequence: CTC
cagcctgggtgacagagcga

SEQ ID NO: 15339 - DNA, 20 bp, Artificial Sequence
  Description of Artificial Sequence: Synthetic oligonucleotide
  Target: SOD1; (+) strand; PAM type: YTN; PAM sequence: CTG
ggtgacagagcgagaccctg

SEQ ID NO: 15340 - DNA, 20 bp, Artificial Sequence
  Description of Artificial Sequence: Synthetic oligonucleotide
  Target: SOD1; (+) strand; PAM type: YTN; PAM sequence: CTG
tctcaaaaatcaaacaaaca

SEQ ID NO: 15341 - DNA, 20 bp, Artificial Sequence
  Description of Artificial Sequence: Synthetic oligonucleotide
  Target: SOD1; (+) strand; PAM type: YTN; PAM sequence: CTC
aaaaatcaaacaaacaaccc

SEQ ID NO: 15342 - DNA, 20 bp, Artificial Sequence
  Description of Artificial Sequence: Synthetic oligonucleotide
  Target: SOD1; (+) strand; PAM type: YTN; PAM sequence: CTC
gccccggacaaaagtagttt

SEQ ID NO: 15343 - DNA, 20 bp, Artificial Sequence
  Description of Artificial Sequence: Synthetic oligonucleotide
  Target: SOD1; (+) strand; PAM type: YTN; PAM sequence: TTT
gcactattttctcatttcac

SEQ ID NO: 15344 - DNA, 20 bp, Artificial Sequence
  Description of Artificial Sequence: Synthetic oligonucleotide
  Target: SOD1; (+) strand; PAM type: YTN; PAM sequence: TTG
cactattttctcatttcaca

SEQ ID NO: 15345 - DNA, 20 bp, Artificial Sequence
  Description of Artificial Sequence: Synthetic oligonucleotide
  Target: SOD1; (+) strand; PAM type: YTN; PAM sequence: CTA
ttttctcatttcacaatatg

SEQ ID NO: 15346 - DNA, 20 bp, Artificial Sequence
  Description of Artificial Sequence: Synthetic oligonucleotide
  Target: SOD1; (+) strand; PAM type: YTN; PAM sequence: TTT
tctcatttcacaatatgttt

SEQ ID NO: 15347 - DNA, 20 bp, Artificial Sequence
  Description of Artificial Sequence: Synthetic oligonucleotide
  Target: SOD1; (+) strand; PAM type: YTN; PAM sequence: TTT
ctcatttcacaatatgtttt

SEQ ID NO: 15348 - DNA, 20 bp, Artificial Sequence
  Description of Artificial Sequence: Synthetic oligonucleotide
  Target: SOD1; (+) strand; PAM type: YTN; PAM sequence: TTC
tcatttcacaatatgttttt

SEQ ID NO: 15349 - DNA, 20 bp, Artificial Sequence
  Description of Artificial Sequence: Synthetic oligonucleotide
  Target: SOD1; (+) strand; PAM type: YTN; PAM sequence: CTC
atttcacaatatgtttttga

SEQ ID NO: 15350 - DNA, 20 bp, Artificial Sequence
  Description of Artificial Sequence: Synthetic oligonucleotide
  Target: SOD1; (+) strand; PAM type: YTN; PAM sequence: TTT
cacaatatgtttttgaaata

SEQ ID NO: 15351 - DNA, 20 bp, Artificial Sequence
  Description of Artificial Sequence: Synthetic oligonucleotide
  Target: SOD1; (+) strand; PAM type: YTN; PAM sequence: TTC
acaatatgtttttgaaatat

SEQ ID NO: 15352 - DNA, 20 bp, Artificial Sequence
  Description of Artificial Sequence: Synthetic oligonucleotide
  Target: SOD1; (+) strand; PAM type: YTN; PAM sequence: TTT
ttgaaatatttcccttgaaa

SEQ ID NO: 15353 - DNA, 20 bp, Artificial Sequence
  Description of Artificial Sequence: Synthetic oligonucleotide
  Target: SOD1; (+) strand; PAM type: YTN; PAM sequence: TTT
tgaaatatttcccttgaaag

SEQ ID NO: 15354 - DNA, 20 bp, Artificial Sequence
  Description of Artificial Sequence: Synthetic oligonucleotide
  Target: SOD1; (+) strand; PAM type: YTN; PAM sequence: TTT
gaaatatttcccttgaaagg

SEQ ID NO: 15355 - DNA, 20 bp, Artificial Sequence
  Description of Artificial Sequence: Synthetic oligonucleotide
  Target: SOD1; (+) strand; PAM type: YTN; PAM sequence: TTG
aaatatttcccttgaaaggt

SEQ ID NO: 15356 - DNA, 20 bp, Artificial Sequence
  Description of Artificial Sequence: Synthetic oligonucleotide
  Target: SOD1; (+) strand; PAM type: YTN; PAM sequence: TTT
cccttgaaaggtaagtcata

SEQ ID NO: 15357 - DNA, 20 bp, Artificial Sequence
  Description of Artificial Sequence: Synthetic oligonucleotide
  Target: SOD1; (+) strand; PAM type: YTN; PAM sequence: TTC
ccttgaaaggtaagtcatat

SEQ ID NO: 15358 - DNA, 20 bp, Artificial Sequence
  Description of Artificial Sequence: Synthetic oligonucleotide
  Target: SOD1; (+) strand; PAM type: YTN; PAM sequence: CTT
gaaaggtaagtcatatttat

SEQ ID NO: 15359 - DNA, 20 bp, Artificial Sequence
  Description of Artificial Sequence: Synthetic oligonucleotide
  Target: SOD1; (+) strand; PAM type: YTN; PAM sequence: TTG
aaaggtaagtcatatttatc

SEQ ID NO: 15360 - DNA, 20 bp, Artificial Sequence
  Description of Artificial Sequence: Synthetic oligonucleotide
  Target: SOD1; (+) strand; PAM type: YTN; PAM sequence: TTT
atcattcctgttgtatggag

SEQ ID NO: 15361 - DNA, 20 bp, Artificial Sequence
  Description of Artificial Sequence: Synthetic oligonucleotide
  Target: SOD1; (+) strand; PAM type: YTN; PAM sequence: TTA
tcattcctgttgtatggagg

SEQ ID NO: 15362 - DNA, 20 bp, Artificial Sequence
  Description of Artificial Sequence: Synthetic oligonucleotide
  Target: SOD1; (+) strand; PAM type: YTN; PAM sequence: TTC
ctgttgtatggaggcatcat

SEQ ID NO: 15363 - DNA, 20 bp, Artificial Sequence
  Description of Artificial Sequence: Synthetic oligonucleotide
  Target: SOD1; (+) strand; PAM type: YTN; PAM sequence: CTG
ttgtatggaggcatcataaa

SEQ ID NO: 15364 - DNA, 20 bp, Artificial Sequence
  Description of Artificial Sequence: Synthetic oligonucleotide
  Target: SOD1; (+) strand; PAM type: YTN; PAM sequence: TTG
tatggaggcatcataaatta

SEQ ID NO: 15365 - DNA, 20 bp, Artificial Sequence
  Description of Artificial Sequence: Synthetic oligonucleotide
  Target: SOD1; (+) strand; PAM type: YTN; PAM sequence: TTA
tttcaccattctaccctcct

SEQ ID NO: 15366 - DNA, 20 bp, Artificial Sequence
  Description of Artificial Sequence: Synthetic oligonucleotide
  Target: SOD1; (+) strand; PAM type: YTN; PAM sequence: TTT
caccattctaccctccttga

SEQ ID NO: 15367 - DNA, 20 bp, Artificial Sequence
  Description of Artificial Sequence: Synthetic oligonucleotide
  Target: SOD1; (+) strand; PAM type: YTN; PAM sequence: TTC
accattctaccctccttgag

SEQ ID NO: 15368 - DNA, 20 bp, Artificial Sequence
  Description of Artificial Sequence: Synthetic oligonucleotide
  Target: SOD1; (+) strand; PAM type: YTN; PAM sequence: TTC
taccctccttgagtgttgtg

SEQ ID NO: 15369 - DNA, 20 bp, Artificial Sequence
  Description of Artificial Sequence: Synthetic oligonucleotide
  Target: SOD1; (+) strand; PAM type: YTN; PAM sequence: CTA
ccctccttgagtgttgtggc

SEQ ID NO: 15370 - DNA, 20 bp, Artificial Sequence
  Description of Artificial Sequence: Synthetic oligonucleotide
  Target: SOD1; (+) strand; PAM type: YTN; PAM sequence: CTC
cttgagtgttgtggccttta

SEQ ID NO: 15371 - DNA, 20 bp, Artificial Sequence
  Description of Artificial Sequence: Synthetic oligonucleotide
  Target: SOD1; (+) strand; PAM type: YTN; PAM sequence: CTT
gagtgttgtggcctttaggc

SEQ ID NO: 15372 - DNA, 20 bp, Artificial Sequence
  Description of Artificial Sequence: Synthetic oligonucleotide
  Target: SOD1; (+) strand; PAM type: YTN; PAM sequence: TTG
agtgttgtggcctttaggcc

SEQ ID NO: 15373 - DNA, 20 bp, Artificial Sequence
  Description of Artificial Sequence: Synthetic oligonucleotide
  Target: SOD1; (+) strand; PAM type: YTN; PAM sequence: TTG
tggcctttaggccagacaaa

SEQ ID NO: 15374 - DNA, 20 bp, Artificial Sequence
  Description of Artificial Sequence: Synthetic oligonucleotide
  Target: SOD1; (+) strand; PAM type: YTN; PAM sequence: CTT
taggccagacaaaaacgcag

SEQ ID NO: 15375 - DNA, 20 bp, Artificial Sequence
  Description of Artificial Sequence: Synthetic oligonucleotide
  Target: SOD1; (+) strand; PAM type: YTN; PAM sequence: TTT
aggccagacaaaaacgcagg

SEQ ID NO: 15376 - DNA, 20 bp, Artificial Sequence
  Description of Artificial Sequence: Synthetic oligonucleotide
  Target: SOD1; (+) strand; PAM type: YTN; PAM sequence: TTA
ggccagacaaaaacgcaggt

SEQ ID NO: 15377 - DNA, 20 bp, Artificial Sequence
  Description of Artificial Sequence: Synthetic oligonucleotide
  Target: SOD1; (+) strand; PAM type: YTN; PAM sequence: CTA
gaagccaactagttgccgtt

SEQ ID NO: 15378 - DNA, 20 bp, Artificial Sequence
  Description of Artificial Sequence: Synthetic oligonucleotide
  Target: SOD1; (+) strand; PAM type: YTN; PAM sequence: CTA
gttgccgtttggttatctgt

SEQ ID NO: 15379 - DNA, 20 bp, Artificial Sequence
  Description of Artificial Sequence: Synthetic oligonucleotide
  Target: SOD1; (+) strand; PAM type: YTN; PAM sequence: TTG
ccgtttggttatctgtaggg

SEQ ID NO: 15380 - DNA, 20 bp, Artificial Sequence
  Description of Artificial Sequence: Synthetic oligonucleotide
  Target: SOD1; (+) strand; PAM type: YTN; PAM sequence: TTT
ggttatctgtagggttgtgg

SEQ ID NO: 15381 - DNA, 20 bp, Artificial Sequence
  Description of Artificial Sequence: Synthetic oligonucleotide
  Target: SOD1; (+) strand; PAM type: YTN; PAM sequence: TTG
gttatctgtagggttgtggc

SEQ ID NO: 15382 - DNA, 20 bp, Artificial Sequence
  Description of Artificial Sequence: Synthetic oligonucleotide
  Target: SOD1; (+) strand; PAM type: YTN; PAM sequence: TTA
tctgtagggttgtggccttg

SEQ ID NO: 15383 - DNA, 20 bp, Artificial Sequence
  Description of Artificial Sequence: Synthetic oligonucleotide
  Target: SOD1; (+) strand; PAM type: YTN; PAM sequence: CTG
tagggttgtggccttgccaa

SEQ ID NO: 15384 - DNA, 20 bp, Artificial Sequence
  Description of Artificial Sequence: Synthetic oligonucleotide
  Target: SOD1; (+) strand; PAM type: YTN; PAM sequence: TTG
tggccttgccaaacaggaaa

SEQ ID NO: 15385 - DNA, 20 bp, Artificial Sequence
  Description of Artificial Sequence: Synthetic oligonucleotide
  Target: SOD1; (+) strand; PAM type: YTN; PAM sequence: CTT
gccaaacaggaaaaatataa

SEQ ID NO: 15386 - DNA, 20 bp, Artificial Sequence
  Description of Artificial Sequence: Synthetic oligonucleotide
  Target: SOD1; (+) strand; PAM type: YTN; PAM sequence: TTG
ccaaacaggaaaaatataaa

SEQ ID NO: 15387 - DNA, 20 bp, Artificial Sequence
  Description of Artificial Sequence: Synthetic oligonucleotide
  Target: SOD1; (+) strand; PAM type: YTN; PAM sequence: TTC
tgccaaccaaataagaaact

SEQ ID NO: 15388 - DNA, 20 bp, Artificial Sequence
  Description of Artificial Sequence: Synthetic oligonucleotide
  Target: SOD1; (+) strand; PAM type: YTN; PAM sequence: CTG
ccaaccaaataagaaactct

SEQ ID NO: 15389 - DNA, 20 bp, Artificial Sequence
  Description of Artificial Sequence: Synthetic oligonucleotide
  Target: SOD1; (+) strand; PAM type: YTN; PAM sequence: CTC
tatactaaggactaagaaaa

SEQ ID NO: 15390 - DNA, 20 bp, Artificial Sequence
  Description of Artificial Sequence: Synthetic oligonucleotide
  Target: SOD1; (+) strand; PAM type: YTN; PAM sequence: CTA
tactaaggactaagaaaatt

SEQ ID NO: 15391 - DNA, 20 bp, Artificial Sequence
  Description of Artificial Sequence: Synthetic oligonucleotide
  Target: SOD1; (+) strand; PAM type: YTN; PAM sequence: CTA
aggactaagaaaattgcagg

SEQ ID NO: 15392 - DNA, 20 bp, Artificial Sequence
  Description of Artificial Sequence: Synthetic oligonucleotide
  Target: SOD1; (+) strand; PAM type: YTN; PAM sequence: CTA
agaaaattgcaggggaagaa

SEQ ID NO: 15393 - DNA, 20 bp, Artificial Sequence
  Description of Artificial Sequence: Synthetic oligonucleotide
  Target: SOD1; (+) strand; PAM type: YTN; PAM sequence: TTG
caggggaagaaaaggtaagt

SEQ ID NO: 15394 - DNA, 20 bp, Artificial Sequence
  Description of Artificial Sequence: Synthetic oligonucleotide
  Target: SOD1; (+) strand; PAM type: YTN; PAM sequence: TTG
aggtgtagcgactttctata

SEQ ID NO: 15395 - DNA, 20 bp, Artificial Sequence
  Description of Artificial Sequence: Synthetic oligonucleotide
  Target: SOD1; (+) strand; PAM type: YTN; PAM sequence: CTT
tctataccctcagaaaacta

SEQ ID NO: 15396 - DNA, 20 bp, Artificial Sequence
  Description of Artificial Sequence: Synthetic oligonucleotide
  Target: SOD1; (+) strand; PAM type: YTN; PAM sequence: TTT
ctataccctcagaaaactaa

SEQ ID NO: 15397 - DNA, 20 bp, Artificial Sequence
  Description of Artificial Sequence: Synthetic oligonucleotide
  Target: SOD1; (+) strand; PAM type: YTN; PAM sequence: TTC
tataccctcagaaaactaaa

SEQ ID NO: 15398 - DNA, 20 bp, Artificial Sequence
  Description of Artificial Sequence: Synthetic oligonucleotide
  Target: SOD1; (+) strand; PAM type: YTN; PAM sequence: CTA
taccctcagaaaactaaaaa

SEQ ID NO: 15399 - DNA, 20 bp, Artificial Sequence
  Description of Artificial Sequence: Synthetic oligonucleotide
  Target: SOD1; (+) strand; PAM type: YTN; PAM sequence: CTC
agaaaactaaaaaacaagac

SEQ ID NO: 15400 - DNA, 20 bp, Artificial Sequence
  Description of Artificial Sequence: Synthetic oligonucleotide
  Target: SOD1; (+) strand; PAM type: YTN; PAM sequence: CTA
aaaaacaagacaaaaaaatg

SEQ ID NO: 15401 - DNA, 20 bp, Artificial Sequence
  Description of Artificial Sequence: Synthetic oligonucleotide
  Target: SOD1; (+) strand; PAM type: YTN; PAM sequence: CTA
caaaagcatccatcttgggg

SEQ ID NO: 15402 - DNA, 20 bp, Artificial Sequence
  Description of Artificial Sequence: Synthetic oligonucleotide
  Target: SOD1; (+) strand; PAM type: YTN; PAM sequence: CTT
ggggcgtcccaattgctgag

SEQ ID NO: 15403 - DNA, 20 bp, Artificial Sequence
  Description of Artificial Sequence: Synthetic oligonucleotide
  Target: SOD1; (+) strand; PAM type: YTN; PAM sequence: TTG
gggcgtcccaattgctgagt

SEQ ID NO: 15404 - DNA, 20 bp, Artificial Sequence
  Description of Artificial Sequence: Synthetic oligonucleotide
  Target: SOD1; (+) strand; PAM type: YTN; PAM sequence: TTG
ctgagtaacaaatgagacgc

SEQ ID NO: 15405 - DNA, 20 bp, Artificial Sequence
  Description of Artificial Sequence: Synthetic oligonucleotide
  Target: SOD1; (+) strand; PAM type: YTN; PAM sequence: CTG
agtaacaaatgagacgctgt

SEQ ID NO: 15406 - DNA, 20 bp, Artificial Sequence
  Description of Artificial Sequence: Synthetic oligonucleotide
  Target: SOD1; (+) strand; PAM type: YTN; PAM sequence: CTG
tggccaaactcagtcataac

SEQ ID NO: 15407 - DNA, 20 bp, Artificial Sequence
  Description of Artificial Sequence: Synthetic oligonucleotide
  Target: SOD1; (+) strand; PAM type: YTN; PAM sequence: CTC
agtcataactaatgacattt

SEQ ID NO: 15408 - DNA, 20 bp, Artificial Sequence
  Description of Artificial Sequence: Synthetic oligonucleotide
  Target: SOD1; (+) strand; PAM type: YTN; PAM sequence: CTA
atgacatttctagacaaagt

SEQ ID NO: 15409 - DNA, 20 bp, Artificial Sequence
  Description of Artificial Sequence: Synthetic oligonucleotide
  Target: SOD1; (+) strand; PAM type: YTN; PAM sequence: TTT
ctagacaaagtgacttcaga

SEQ ID NO: 15410 - DNA, 20 bp, Artificial Sequence
  Description of Artificial Sequence: Synthetic oligonucleotide
  Target: SOD1; (+) strand; PAM type: YTN; PAM sequence: TTC
tagacaaagtgacttcagat

SEQ ID NO: 15411 - DNA, 20 bp, Artificial Sequence
  Description of Artificial Sequence: Synthetic oligonucleotide
  Target: SOD1; (+) strand; PAM type: YTN; PAM sequence: CTA
gacaaagtgacttcagattt

SEQ ID NO: 15412 - DNA, 20 bp, Artificial Sequence
  Description of Artificial Sequence: Synthetic oligonucleotide
  Target: SOD1; (+) strand; PAM type: YTN; PAM sequence: CTT
cagattttcaaagcgtaccc

SEQ ID NO: 15413 - DNA, 20 bp, Artificial Sequence
  Description of Artificial Sequence: Synthetic oligonucleotide
  Target: SOD1; (+) strand; PAM type: YTN; PAM sequence: TTC
agattttcaaagcgtaccct

SEQ ID NO: 15414 - DNA, 20 bp, Artificial Sequence
  Description of Artificial Sequence: Synthetic oligonucleotide
  Target: SOD1; (+) strand; PAM type: YTN; PAM sequence: TTT
tcaaagcgtaccctgtttac

SEQ ID NO: 15415 - DNA, 20 bp, Artificial Sequence
  Description of Artificial Sequence: Synthetic oligonucleotide
  Target: SOD1; (+) strand; PAM type: YTN; PAM sequence: TTT
caaagcgtaccctgtttaca

SEQ ID NO: 15416 - DNA, 20 bp, Artificial Sequence
  Description of Artificial Sequence: Synthetic oligonucleotide
  Target: SOD1; (+) strand; PAM type: YTN; PAM sequence: TTC
aaagcgtaccctgtttacat

SEQ ID NO: 15417 - DNA, 20 bp, Artificial Sequence
  Description of Artificial Sequence: Synthetic oligonucleotide
  Target: SOD1; (+) strand; PAM type: YTN; PAM sequence: CTG
tttacatcattttgccaatt

SEQ ID NO: 15418 - DNA, 20 bp, Artificial Sequence
  Description of Artificial Sequence: Synthetic oligonucleotide
  Target: SOD1; (+) strand; PAM type: YTN; PAM sequence: TTT
acatcattttgccaatttcg

SEQ ID NO: 15419 - DNA, 20 bp, Artificial Sequence
  Description of Artificial Sequence: Synthetic oligonucleotide
  Target: SOD1; (+) strand; PAM type: YTN; PAM sequence: TTA
catcattttgccaatttcgc

SEQ ID NO: 15420 - DNA, 20 bp, Artificial Sequence
  Description of Artificial Sequence: Synthetic oligonucleotide
  Target: SOD1; (+) strand; PAM type: YTN; PAM sequence: TTT
tgccaatttcgcgtactgca

SEQ ID NO: 15421 - DNA, 20 bp, Artificial Sequence
  Description of Artificial Sequence: Synthetic oligonucleotide
  Target: SOD1; (+) strand; PAM type: YTN; PAM sequence: TTT
gccaatttcgcgtactgcaa

SEQ ID NO: 15422 - DNA, 20 bp, Artificial Sequence
  Description of Artificial Sequence: Synthetic oligonucleotide
  Target: SOD1; (+) strand; PAM type: YTN; PAM sequence: TTG
ccaatttcgcgtactgcaac

SEQ ID NO: 15423 - DNA, 20 bp, Artificial Sequence
  Description of Artificial Sequence: Synthetic oligonucleotide
  Target: SOD1; (+) strand; PAM type: YTN; PAM sequence: TTT
cgcgtactgcaaccggcggg

SEQ ID NO: 15424 - DNA, 20 bp, Artificial Sequence
  Description of Artificial Sequence: Synthetic oligonucleotide
  Target: SOD1; (+) strand; PAM type: YTN; PAM sequence: TTC
gcgtactgcaaccggcgggc

SEQ ID NO: 15425 - DNA, 20 bp, Artificial Sequence
  Description of Artificial Sequence: Synthetic oligonucleotide
  Target: SOD1; (+) strand; PAM type: YTN; PAM sequence: CTG
caaccggcgggccacgcccc

SEQ ID NO: 15426 - DNA, 20 bp, Artificial Sequence
  Description of Artificial Sequence: Synthetic oligonucleotide
  Target: SOD1; (+) strand; PAM type: YTN; PAM sequence: TTG
ttttctccacatttcggggt

SEQ ID NO: 15427 - DNA, 20 bp, Artificial Sequence
  Description of Artificial Sequence: Synthetic oligonucleotide
  Target: SOD1; (+) strand; PAM type: YTN; PAM sequence: TTT
tctccacatttcggggttct

SEQ ID NO: 15428 - DNA, 20 bp, Artificial Sequence
  Description of Artificial Sequence: Synthetic oligonucleotide
  Target: SOD1; (+) strand; PAM type: YTN; PAM sequence: TTT
ctccacatttcggggttctg

SEQ ID NO: 15429 - DNA, 20 bp, Artificial Sequence
  Description of Artificial Sequence: Synthetic oligonucleotide
  Target: SOD1; (+) strand; PAM type: YTN; PAM sequence: TTC
tccacatttcggggttctgg

SEQ ID NO: 15430 - DNA, 20 bp, Artificial Sequence
  Description of Artificial Sequence: Synthetic oligonucleotide
  Target: SOD1; (+) strand; PAM type: YTN; PAM sequence: CTC
cacatttcggggttctggac

SEQ ID NO: 15431 - DNA, 20 bp, Artificial Sequence
  Description of Artificial Sequence: Synthetic oligonucleotide
  Target: SOD1; (+) strand; PAM type: YTN; PAM sequence: TTT
cggggttctggacgtttccc

SEQ ID NO: 15432 - DNA, 20 bp, Artificial Sequence
  Description of Artificial Sequence: Synthetic oligonucleotide
  Target: SOD1; (+) strand; PAM type: YTN; PAM sequence: TTC
ggggttctggacgtttcccg

SEQ ID NO: 15433 - DNA, 20 bp, Artificial Sequence
  Description of Artificial Sequence: Synthetic oligonucleotide
  Target: SOD1; (+) strand; PAM type: YTN; PAM sequence: TTC
tggacgtttcccggctgcgg

SEQ ID NO: 15434 - DNA, 20 bp, Artificial Sequence
  Description of Artificial Sequence: Synthetic oligonucleotide
  Target: SOD1; (+) strand; PAM type: YTN; PAM sequence: CTG
gacgtttcccggctgcgggg

SEQ ID NO: 15435 - DNA, 20 bp, Artificial Sequence
  Description of Artificial Sequence: Synthetic oligonucleotide
  Target: SOD1; (+) strand; PAM type: YTN; PAM sequence: TTT
cccggctgcggggcgggggg

SEQ ID NO: 15436 - DNA, 20 bp, Artificial Sequence
  Description of Artificial Sequence: Synthetic oligonucleotide
  Target: SOD1; (+) strand; PAM type: YTN; PAM sequence: TTC
ccggctgcggggcgggggga

SEQ ID NO: 15437 - DNA, 20 bp, Artificial Sequence
  Description of Artificial Sequence: Synthetic oligonucleotide
  Target: SOD1; (+) strand; PAM type: YTN; PAM sequence: CTG
cggggcggggggagtctccg

SEQ ID NO: 15438 - DNA, 20 bp, Artificial Sequence
  Description of Artificial Sequence: Synthetic oligonucleotide
  Target: SOD1; (+) strand; PAM type: YTN; PAM sequence: CTC
cggcgcacgcggccccttgg

SEQ ID NO: 15439 - DNA, 20 bp, Artificial Sequence
  Description of Artificial Sequence: Synthetic oligonucleotide
  Target: SOD1; (+) strand; PAM type: YTN; PAM sequence: CTT
ggccccgcccccagtcattc

SEQ ID NO: 15440 - DNA, 20 bp, Artificial Sequence
  Description of Artificial Sequence: Synthetic oligonucleotide
  Target: SOD1; (+) strand; PAM type: YTN; PAM sequence: TTG
gccccgcccccagtcattcc

SEQ ID NO: 15441 - DNA, 20 bp, Artificial Sequence
  Description of Artificial Sequence: Synthetic oligonucleotide
  Target: SOD1; (+) strand; PAM type: YTN; PAM sequence: TTC
ccggccactcgcgacccgag

SEQ ID NO: 15442 - DNA, 20 bp, Artificial Sequence
  Description of Artificial Sequence: Synthetic oligonucleotide
  Target: SOD1; (+) strand; PAM type: YTN; PAM sequence: CTC
gcgacccgaggctgccgcag

SEQ ID NO: 15443 - DNA, 20 bp, Artificial Sequence
  Description of Artificial Sequence: Synthetic oligonucleotide
  Target: SOD1; (+) strand; PAM type: YTN; PAM sequence: CTG
ccgcagggggcgggctgagc

SEQ ID NO: 15444 - DNA, 20 bp, Artificial Sequence
  Description of Artificial Sequence: Synthetic oligonucleotide
  Target: SOD1; (+) strand; PAM type: YTN; PAM sequence: CTG
agcgcgtgcgaggcgattgg

SEQ ID NO: 15445 - DNA, 20 bp, Artificial Sequence
  Description of Artificial Sequence: Synthetic oligonucleotide
  Target: SOD1; (+) strand; PAM type: YTN; PAM sequence: TTG
gtttggggccagagtgggcg

SEQ ID NO: 15446 - DNA, 20 bp, Artificial Sequence
  Description of Artificial Sequence: Synthetic oligonucleotide
  Target: SOD1; (+) strand; PAM type: YTN; PAM sequence: TTT
ggggccagagtgggcgaggc

SEQ ID NO: 15447 - DNA, 20 bp, Artificial Sequence
  Description of Artificial Sequence: Synthetic oligonucleotide
  Target: SOD1; (+) strand; PAM type: YTN; PAM sequence: TTG
gggccagagtgggcgaggcg

SEQ ID NO: 15448 - DNA, 20 bp, Artificial Sequence
  Description of Artificial Sequence: Synthetic oligonucleotide
  Target: SOD1; (+) strand; PAM type: YTN; PAM sequence: CTG
gcctataaagtagtcgcgga

SEQ ID NO: 15449 - DNA, 20 bp, Artificial Sequence
  Description of Artificial Sequence: Synthetic oligonucleotide
  Target: SOD1; (+) strand; PAM type: YTN; PAM sequence: CTA
taaagtagtcgcggagacgg

SEQ ID NO: 15450 - DNA, 20 bp, Artificial Sequence
  Description of Artificial Sequence: Synthetic oligonucleotide
  Target: SOD1; (+) strand; PAM type: YTN; PAM sequence: CTG
gtttgcgtcgtagtctcctg

SEQ ID NO: 15451 - DNA, 20 bp, Artificial Sequence
  Description of Artificial Sequence: Synthetic oligonucleotide
  Target: SOD1; (+) strand; PAM type: YTN; PAM sequence: TTT
gcgtcgtagtctcctgcagc

SEQ ID NO: 15452 - DNA, 20 bp, Artificial Sequence
  Description of Artificial Sequence: Synthetic oligonucleotide
  Target: SOD1; (+) strand; PAM type: YTN; PAM sequence: TTG
cgtcgtagtctcctgcagcg

SEQ ID NO: 15453 - DNA, 20 bp, Artificial Sequence
  Description of Artificial Sequence: Synthetic oligonucleotide
  Target: SOD1; (+) strand; PAM type: YTN; PAM sequence: CTC
ctgcagcgtctggggtttcc

SEQ ID NO: 15454 - DNA, 20 bp, Artificial Sequence
  Description of Artificial Sequence: Synthetic oligonucleotide
  Target: SOD1; (+) strand; PAM type: YTN; PAM sequence: CTG
cagcgtctggggtttccgtt

SEQ ID NO: 15455 - DNA, 20 bp, Artificial Sequence
  Description of Artificial Sequence: Synthetic oligonucleotide
  Target: SOD1; (+) strand; PAM type: YTN; PAM sequence: CTG
gggtttccgttgcagtcctc

SEQ ID NO: 15456 - DNA, 20 bp, Artificial Sequence
  Description of Artificial Sequence: Synthetic oligonucleotide
  Target: SOD1; (+) strand; PAM type: YTN; PAM sequence: TTT
ccgttgcagtcctcggaacc

SEQ ID NO: 15457 - DNA, 20 bp, Artificial Sequence
  Description of Artificial Sequence: Synthetic oligonucleotide
  Target: SOD1; (+) strand; PAM type: YTN; PAM sequence: TTC
cgttgcagtcctcggaacca

SEQ ID NO: 15458 - DNA, 20 bp, Artificial Sequence
  Description of Artificial Sequence: Synthetic oligonucleotide
  Target: SOD1; (+) strand; PAM type: YTN; PAM sequence: TTG
cagtcctcggaaccaggacc

SEQ ID NO: 15459 - DNA, 20 bp, Artificial Sequence
  Description of Artificial Sequence: Synthetic oligonucleotide
  Target: SOD1; (+) strand; PAM type: YTN; PAM sequence: CTC
ggaaccaggacctcggcgtg

SEQ ID NO: 15460 - DNA, 20 bp, Artificial Sequence
  Description of Artificial Sequence: Synthetic oligonucleotide
  Target: SOD1; (+) strand; PAM type: YTN; PAM sequence: CTC
ggcgtggcctagcgagttat

SEQ ID NO: 15461 - DNA, 20 bp, Artificial Sequence
  Description of Artificial Sequence: Synthetic oligonucleotide
  Target: SOD1; (+) strand; PAM type: YTN; PAM sequence: CTA
gcgagttatggcgacgaagg

SEQ ID NO: 15462 - DNA, 20 bp, Artificial Sequence
  Description of Artificial Sequence: Synthetic oligonucleotide
  Target: SOD1; (+) strand; PAM type: YTN; PAM sequence: TTA
tggcgacgaaggccgtgtgc

SEQ ID NO: 15463 - DNA, 20 bp, Artificial Sequence
  Description of Artificial Sequence: Synthetic oligonucleotide
  Target: SOD1; (+) strand; PAM type: YTN; PAM sequence: CTG
aagggcgacggcccagtgca

SEQ ID NO: 15464 - DNA, 20 bp, Artificial Sequence
  Description of Artificial Sequence: Synthetic oligonucleotide
  Target: SOD1; (+) strand; PAM type: YTN; PAM sequence: TTT
cgagcagaaggcaagggctg

SEQ ID NO: 15465 - DNA, 20 bp, Artificial Sequence
  Description of Artificial Sequence: Synthetic oligonucleotide
  Target: SOD1; (+) strand; PAM type: YTN; PAM sequence: TTC
gagcagaaggcaagggctgg

SEQ ID NO: 15466 - DNA, 20 bp, Artificial Sequence
  Description of Artificial Sequence: Synthetic oligonucleotide
  Target: SOD1; (+) strand; PAM type: YTN; PAM sequence: CTG
ggacggaggcttgtttgcga

SEQ ID NO: 15467 - DNA, 20 bp, Artificial Sequence
  Description of Artificial Sequence: Synthetic oligonucleotide
  Target: SOD1; (+) strand; PAM type: YTN; PAM sequence: CTT
gtttgcgaggccgctcccac

SEQ ID NO: 15468 - DNA, 20 bp, Artificial Sequence
  Description of Artificial Sequence: Synthetic oligonucleotide
  Target: SOD1; (+) strand; PAM type: YTN; PAM sequence: TTG
tttgcgaggccgctcccacc

SEQ ID NO: 15469 - DNA, 20 bp, Artificial Sequence
  Description of Artificial Sequence: Synthetic oligonucleotide
  Target: SOD1; (+) strand; PAM type: YTN; PAM sequence: TTT
gcgaggccgctcccacccgc

SEQ ID NO: 15470 - DNA, 20 bp, Artificial Sequence
  Description of Artificial Sequence: Synthetic oligonucleotide
  Target: SOD1; (+) strand; PAM type: YTN; PAM sequence: TTG
cgaggccgctcccacccgct

SEQ ID NO: 15471 - DNA, 20 bp, Artificial Sequence
  Description of Artificial Sequence: Synthetic oligonucleotide
  Target: SOD1; (+) strand; PAM type: YTN; PAM sequence: CTC
ccacccgctcgtccccccgc

SEQ ID NO: 15472 - DNA, 20 bp, Artificial Sequence
  Description of Artificial Sequence: Synthetic oligonucleotide
  Target: SOD1; (+) strand; PAM type: YTN; PAM sequence: CTC
gtccccccgcgcacctttgc

SEQ ID NO: 15473 - DNA, 20 bp, Artificial Sequence
  Description of Artificial Sequence: Synthetic oligonucleotide
  Target: SOD1; (+) strand; PAM type: YTN; PAM sequence: CTT
tgctaggagcgggtcgcccg

SEQ ID NO: 15474 - DNA, 20 bp, Artificial Sequence
  Description of Artificial Sequence: Synthetic oligonucleotide
  Target: SOD1; (+) strand; PAM type: YTN; PAM sequence: TTT
gctaggagcgggtcgcccgc

SEQ ID NO: 15475 - DNA, 20 bp, Artificial Sequence
  Description of Artificial Sequence: Synthetic oligonucleotide
  Target: SOD1; (+) strand; PAM type: YTN; PAM sequence: TTG
ctaggagcgggtcgcccgcc

SEQ ID NO: 15476 - DNA, 20 bp, Artificial Sequence
  Description of Artificial Sequence: Synthetic oligonucleotide
  Target: SOD1; (+) strand; PAM type: YTN; PAM sequence: CTA
ggagcgggtcgcccgccagg

SEQ ID NO: 15477 - DNA, 20 bp, Artificial Sequence
  Description of Artificial Sequence: Synthetic oligonucleotide
  Target: SOD1; (+) strand; PAM type: YTN; PAM sequence: CTC
ggggccgccctggtccagcg

SEQ ID NO: 15478 - DNA, 20 bp, Artificial Sequence
  Description of Artificial Sequence: Synthetic oligonucleotide
  Target: SOD1; (+) strand; PAM type: YTN; PAM sequence: CTG
gtccagcgcccggtcccggc

SEQ ID NO: 15479 - DNA, 20 bp, Artificial Sequence
  Description of Artificial Sequence: Synthetic oligonucleotide
  Target: SOD1; (+) strand; PAM type: YTN; PAM sequence: CTT
cgcccccagcggtgcggtgc

SEQ ID NO: 15480 - DNA, 20 bp, Artificial Sequence
  Description of Artificial Sequence: Synthetic oligonucleotide
  Target: SOD1; (+) strand; PAM type: YTN; PAM sequence: TTC
gcccccagcggtgcggtgcc

SEQ ID NO: 15481 - DNA, 20 bp, Artificial Sequence
  Description of Artificial Sequence: Synthetic oligonucleotide
  Target: SOD1; (+) strand; PAM type: YTN; PAM sequence: CTG
agtcaccgggcgggcccggg

SEQ ID NO: 15482 - DNA, 20 bp, Artificial Sequence
  Description of Artificial Sequence: Synthetic oligonucleotide
  Target: SOD1; (+) strand; PAM type: YTN; PAM sequence: CTG
ggcctgcgcgtggcgggagc

SEQ ID NO: 15483 - DNA, 20 bp, Artificial Sequence
  Description of Artificial Sequence: Synthetic oligonucleotide
  Target: SOD1; (+) strand; PAM type: YTN; PAM sequence: CTG
cgcgtggcgggagcgcgggg

SEQ ID NO: 15484 - DNA, 20 bp, Artificial Sequence
  Description of Artificial Sequence: Synthetic oligonucleotide
  Target: SOD1; (+) strand; PAM type: YTN; PAM sequence: TTG
ccgcgggccggggaggggcg

SEQ ID NO: 15485 - DNA, 20 bp, Artificial Sequence
  Description of Artificial Sequence: Synthetic oligonucleotide
  Target: SOD1; (+) strand; PAM type: YTN; PAM sequence: CTG
ccctctgtggtccttgggcc

SEQ ID NO: 15486 - DNA, 20 bp, Artificial Sequence
  Description of Artificial Sequence: Synthetic oligonucleotide
  Target: SOD1; (+) strand; PAM type: YTN; PAM sequence: CTC
tgtggtccttgggccgccgc

SEQ ID NO: 15487 - DNA, 20 bp, Artificial Sequence
  Description of Artificial Sequence: Synthetic oligonucleotide
  Target: SOD1; (+) strand; PAM type: YTN; PAM sequence: CTG
tggtccttgggccgccgccg

SEQ ID NO: 15488 - DNA, 20 bp, Artificial Sequence
  Description of Artificial Sequence: Synthetic oligonucleotide
  Target: SOD1; (+) strand; PAM type: YTN; PAM sequence: CTT
gggccgccgccgcgggtctg

SEQ ID NO: 15489 - DNA, 20 bp, Artificial Sequence
  Description of Artificial Sequence: Synthetic oligonucleotide
  Target: SOD1; (+) strand; PAM type: YTN; PAM sequence: TTG
ggccgccgccgcgggtctgt

SEQ ID NO: 15490 - DNA, 20 bp, Artificial Sequence
  Description of Artificial Sequence: Synthetic oligonucleotide
  Target: SOD1; (+) strand; PAM type: YTN; PAM sequence: CTG
tcgtggtgcctggagcggct

SEQ ID NO: 15491 - DNA, 20 bp, Artificial Sequence
  Description of Artificial Sequence: Synthetic oligonucleotide
  Target: SOD1; (+) strand; PAM type: YTN; PAM sequence: CTG
gagcggctgtgctcgtccct

SEQ ID NO: 15492 - DNA, 20 bp, Artificial Sequence
  Description of Artificial Sequence: Synthetic oligonucleotide
  Target: SOD1; (+) strand; PAM type: YTN; PAM sequence: CTG
tgctcgtcccttgcttggcc

SEQ ID NO: 15493 - DNA, 20 bp, Artificial Sequence
  Description of Artificial Sequence: Synthetic oligonucleotide
  Target: SOD1; (+) strand; PAM type: YTN; PAM sequence: CTC
gtcccttgcttggccgtgtt

SEQ ID NO: 15494 - DNA, 20 bp, Artificial Sequence
  Description of Artificial Sequence: Synthetic oligonucleotide
  Target: SOD1; (+) strand; PAM type: YTN; PAM sequence: CTT
gcttggccgtgttctcgttc

SEQ ID NO: 15495 - DNA, 20 bp, Artificial Sequence
  Description of Artificial Sequence: Synthetic oligonucleotide
  Target: SOD1; (+) strand; PAM type: YTN; PAM sequence: TTG
cttggccgtgttctcgttcc

SEQ ID NO: 15496 - DNA, 20 bp, Artificial Sequence
  Description of Artificial Sequence: Synthetic oligonucleotide
  Target: SOD1; (+) strand; PAM type: YTN; PAM sequence: CTT
ggccgtgttctcgttcctga

SEQ ID NO: 15497 - DNA, 20 bp, Artificial Sequence
  Description of Artificial Sequence: Synthetic oligonucleotide
  Target: SOD1; (+) strand; PAM type: YTN; PAM sequence: TTG
gccgtgttctcgttcctgag

SEQ ID NO: 15498 - DNA, 20 bp, Artificial Sequence
  Description of Artificial Sequence: Synthetic oligonucleotide
  Target: SOD1; (+) strand; PAM type: YTN; PAM sequence: TTC
tcgttcctgagggtcccgcg

SEQ ID NO: 15499 - DNA, 20 bp, Artificial Sequence
  Description of Artificial Sequence: Synthetic oligonucleotide
  Target: SOD1; (+) strand; PAM type: YTN; PAM sequence: CTC
gttcctgagggtcccgcgga

SEQ ID NO: 15500 - DNA, 20 bp, Artificial Sequence
  Description of Artificial Sequence: Synthetic oligonucleotide
  Target: SOD1; (+) strand; PAM type: YTN; PAM sequence: TTC
ctgagggtcccgcggacacc

SEQ ID NO: 15501 - DNA, 20 bp, Artificial Sequence
  Description of Artificial Sequence: Synthetic oligonucleotide
  Target: SOD1; (+) strand; PAM type: YTN; PAM sequence: CTG
agggtcccgcggacaccgag

SEQ ID NO: 15502 - DNA, 20 bp, Artificial Sequence
  Description of Artificial Sequence: Synthetic oligonucleotide
  Target: SOD1; (+) strand; PAM type: YTN; PAM sequence: CTG
cgcctgggcccgcctggtgt

SEQ ID NO: 15503 - DNA, 20 bp, Artificial Sequence
  Description of Artificial Sequence: Synthetic oligonucleotide
  Target: SOD1; (+) strand; PAM type: YTN; PAM sequence: CTG
ggcccgcctggtgtcttcgc

SEQ ID NO: 15504 - DNA, 20 bp, Artificial Sequence
  Description of Artificial Sequence: Synthetic oligonucleotide
  Target: SOD1; (+) strand; PAM type: YTN; PAM sequence: CTG
gtgtcttcgcatccctctcc

SEQ ID NO: 15505 - DNA, 20 bp, Artificial Sequence
  Description of Artificial Sequence: Synthetic oligonucleotide
  Target: SOD1; (+) strand; PAM type: YTN; PAM sequence: CTT
cgcatccctctccgctttcc

SEQ ID NO: 15506 - DNA, 20 bp, Artificial Sequence
  Description of Artificial Sequence: Synthetic oligonucleotide
  Target: SOD1; (+) strand; PAM type: YTN; PAM sequence: TTC
gcatccctctccgctttccg

SEQ ID NO: 15507 - DNA, 20 bp, Artificial Sequence
  Description of Artificial Sequence: Synthetic oligonucleotide
  Target: SOD1; (+) strand; PAM type: YTN; PAM sequence: CTC
tccgctttccggcttcagcg

SEQ ID NO: 15508 - DNA, 20 bp, Artificial Sequence
  Description of Artificial Sequence: Synthetic oligonucleotide
  Target: SOD1; (+) strand; PAM type: YTN; PAM sequence: CTC
cgctttccggcttcagcgct

SEQ ID NO: 15509 - DNA, 20 bp, Artificial Sequence
  Description of Artificial Sequence: Synthetic oligonucleotide
  Target: SOD1; (+) strand; PAM type: YTN; PAM sequence: CTT
tccggcttcagcgctctagg

SEQ ID NO: 15510 - DNA, 20 bp, Artificial Sequence
  Description of Artificial Sequence: Synthetic oligonucleotide
  Target: SOD1; (+) strand; PAM type: YTN; PAM sequence: TTT
ccggcttcagcgctctaggt

SEQ ID NO: 15511 - DNA, 20 bp, Artificial Sequence
  Description of Artificial Sequence: Synthetic oligonucleotide
  Target: SOD1; (+) strand; PAM type: YTN; PAM sequence: TTC
cggcttcagcgctctaggtc

SEQ ID NO: 15512 - DNA, 20 bp, Artificial Sequence
  Description of Artificial Sequence: Synthetic oligonucleotide
  Target: SOD1; (+) strand; PAM type: YTN; PAM sequence: CTT
cagcgctctaggtcagggag

SEQ ID NO: 15513 - DNA, 20 bp, Artificial Sequence
  Description of Artificial Sequence: Synthetic oligonucleotide
  Target: SOD1; (+) strand; PAM type: YTN; PAM sequence: TTC
agcgctctaggtcagggagt

SEQ ID NO: 15514 - DNA, 20 bp, Artificial Sequence
  Description of Artificial Sequence: Synthetic oligonucleotide
  Target: SOD1; (+) strand; PAM type: YTN; PAM sequence: CTC
taggtcagggagtcttcgct

SEQ ID NO: 15515 - DNA, 20 bp, Artificial Sequence
  Description of Artificial Sequence: Synthetic oligonucleotide
  Target: SOD1; (+) strand; PAM type: YTN; PAM sequence: CTA
ggtcagggagtcttcgcttt

SEQ ID NO: 15516 - DNA, 20 bp, Artificial Sequence
  Description of Artificial Sequence: Synthetic oligonucleotide
  Target: SOD1; (+) strand; PAM type: YTN; PAM sequence: CTT
cgcttttgtacagctctaag

SEQ ID NO: 15517 - DNA, 20 bp, Artificial Sequence
  Description of Artificial Sequence: Synthetic oligonucleotide
  Target: SOD1; (+) strand; PAM type: YTN; PAM sequence: TTC
gcttttgtacagctctaagg

SEQ ID NO: 15518 - DNA, 20 bp, Artificial Sequence
  Description of Artificial Sequence: Synthetic oligonucleotide
  Target: SOD1; (+) strand; PAM type: YTN; PAM sequence: CTT
ttgtacagctctaaggctag

SEQ ID NO: 15519 - DNA, 20 bp, Artificial Sequence
  Description of Artificial Sequence: Synthetic oligonucleotide
  Target: SOD1; (+) strand; PAM type: YTN; PAM sequence: TTT
tgtacagctctaaggctagg

SEQ ID NO: 15520 - DNA, 20 bp, Artificial Sequence
  Description of Artificial Sequence: Synthetic oligonucleotide
  Target: SOD1; (+) strand; PAM type: YTN; PAM sequence: TTT
gtacagctctaaggctagga

SEQ ID NO: 15521 - DNA, 20 bp, Artificial Sequence
  Description of Artificial Sequence: Synthetic oligonucleotide
  Target: SOD1; (+) strand; PAM type: YTN; PAM sequence: TTG
tacagctctaaggctaggaa

SEQ ID NO: 15522 - DNA, 20 bp, Artificial Sequence
  Description of Artificial Sequence: Synthetic oligonucleotide
  Target: SOD1; (+) strand; PAM type: YTN; PAM sequence: CTC
taaggctaggaatggttttt

SEQ ID NO: 15523 - DNA, 20 bp, Artificial Sequence
  Description of Artificial Sequence: Synthetic oligonucleotide
  Target: SOD1; (+) strand; PAM type: YTN; PAM sequence: CTA
aggctaggaatggtttttat

SEQ ID NO: 15524 - DNA, 20 bp, Artificial Sequence
  Description of Artificial Sequence: Synthetic oligonucleotide
  Target: SOD1; (+) strand; PAM type: YTN; PAM sequence: CTA
ggaatggtttttatattttt

SEQ ID NO: 15525 - DNA, 20 bp, Artificial Sequence
  Description of Artificial Sequence: Synthetic oligonucleotide
  Target: SOD1; (+) strand; PAM type: YTN; PAM sequence: TTT
ttatatttttaaaaggcttt

SEQ ID NO: 15526 - DNA, 20 bp, Artificial Sequence
  Description of Artificial Sequence: Synthetic oligonucleotide
  Target: SOD1; (+) strand; PAM type: YTN; PAM sequence: TTT
tatatttttaaaaggctttg

SEQ ID NO: 15527 - DNA, 20 bp, Artificial Sequence
  Description of Artificial Sequence: Synthetic oligonucleotide
  Target: SOD1; (+) strand; PAM type: YTN; PAM sequence: TTT
atatttttaaaaggctttgg

SEQ ID NO: 15528 - DNA, 20 bp, Artificial Sequence
  Description of Artificial Sequence: Synthetic oligonucleotide
  Target: SOD1; (+) strand; PAM type: YTN; PAM sequence: TTA
tatttttaaaaggctttgga

SEQ ID NO: 15529 - DNA, 20 bp, Artificial Sequence
  Description of Artificial Sequence: Synthetic oligonucleotide
  Target: SOD1; (+) strand; PAM type: YTN; PAM sequence: TTT
ttaaaaggctttggaaaaca

SEQ ID NO: 15530 - DNA, 20 bp, Artificial Sequence
  Description of Artificial Sequence: Synthetic oligonucleotide
  Target: SOD1; (+) strand; PAM type: YTN; PAM sequence: TTT
taaaaggctttggaaaacaa

SEQ ID NO: 15531 - DNA, 20 bp, Artificial Sequence
  Description of Artificial Sequence: Synthetic oligonucleotide
  Target: SOD1; (+) strand; PAM type: YTN; PAM sequence: TTT
aaaaggctttggaaaacaaa

SEQ ID NO: 15532 - DNA, 20 bp, Artificial Sequence
  Description of Artificial Sequence: Synthetic oligonucleotide
  Target: SOD1; (+) strand; PAM type: YTN; PAM sequence: TTA
aaaggctttggaaaacaaaa

SEQ ID NO: 15533 - DNA, 20 bp, Artificial Sequence
  Description of Artificial Sequence: Synthetic oligonucleotide
  Target: SOD1; (+) strand; PAM type: YTN; PAM sequence: CTT
tggaaaacaaaaatacgcaa

SEQ ID NO: 15534 - DNA, 20 bp, Artificial Sequence
  Description of Artificial Sequence: Synthetic oligonucleotide
  Target: SOD1; (+) strand; PAM type: YTN; PAM sequence: TTT
ggaaaacaaaaatacgcaac

SEQ ID NO: 15535 - DNA, 20 bp, Artificial Sequence
  Description of Artificial Sequence: Synthetic oligonucleotide
  Target: SOD1; (+) strand; PAM type: YTN; PAM sequence: TTG
gaaaacaaaaatacgcaaca

SEQ ID NO: 15536 - DNA, 20 bp, Artificial Sequence
  Description of Artificial Sequence: Synthetic oligonucleotide
  Target: SOD1; (+) strand; PAM type: YTN; PAM sequence: TTT
gtgtgacactttgcagggaa

SEQ ID NO: 15537 - DNA, 20 bp, Artificial Sequence
  Description of Artificial Sequence: Synthetic oligonucleotide
  Target: SOD1; (+) strand; PAM type: YTN; PAM sequence: TTG
tgtgacactttgcagggaag

SEQ ID NO: 15538 - DNA, 20 bp, Artificial Sequence
  Description of Artificial Sequence: Synthetic oligonucleotide
  Target: SOD1; (+) strand; PAM type: YTN; PAM sequence: CTT
tgcagggaagtttgctggcc

SEQ ID NO: 15539 - DNA, 20 bp, Artificial Sequence
  Description of Artificial Sequence: Synthetic oligonucleotide
  Target: SOD1; (+) strand; PAM type: YTN; PAM sequence: TTT
gcagggaagtttgctggcct

SEQ ID NO: 15540 - DNA, 20 bp, Artificial Sequence
  Description of Artificial Sequence: Synthetic oligonucleotide
  Target: SOD1; (+) strand; PAM type: YTN; PAM sequence: TTG
cagggaagtttgctggcctc

SEQ ID NO: 15541 - DNA, 20 bp, Artificial Sequence
  Description of Artificial Sequence: Synthetic oligonucleotide
  Target: SOD1; (+) strand; PAM type: YTN; PAM sequence: TTT
gctggcctctgttctaggtc

SEQ ID NO: 15542 - DNA, 20 bp, Artificial Sequence
  Description of Artificial Sequence: Synthetic oligonucleotide
  Target: SOD1; (+) strand; PAM type: YTN; PAM sequence: TTG
ctggcctctgttctaggtca

SEQ ID NO: 15543 - DNA, 20 bp, Artificial Sequence
  Description of Artificial Sequence: Synthetic oligonucleotide
  Target: SOD1; (+) strand; PAM type: YTN; PAM sequence: CTG
gcctctgttctaggtcatga

SEQ ID NO: 15544 - DNA, 20 bp, Artificial Sequence
  Description of Artificial Sequence: Synthetic oligonucleotide
  Target: SOD1; (+) strand; PAM type: YTN; PAM sequence: CTC
tgttctaggtcatgattggg

SEQ ID NO: 15545 - DNA, 20 bp, Artificial Sequence
  Description of Artificial Sequence: Synthetic oligonucleotide
  Target: SOD1; (+) strand; PAM type: YTN; PAM sequence: CTG
ttctaggtcatgattgggct

SEQ ID NO: 15546 - DNA, 20 bp, Artificial Sequence
  Description of Artificial Sequence: Synthetic oligonucleotide
  Target: SOD1; (+) strand; PAM type: YTN; PAM sequence: TTC
taggtcatgattgggctgca

SEQ ID NO: 15547 - DNA, 20 bp, Artificial Sequence
  Description of Artificial Sequence: Synthetic oligonucleotide
  Target: SOD1; (+) strand; PAM type: YTN; PAM sequence: CTA
ggtcatgattgggctgcaag

SEQ ID NO: 15548 - DNA, 20 bp, Artificial Sequence
  Description of Artificial Sequence: Synthetic oligonucleotide
  Target: SOD1; (+) strand; PAM type: YTN; PAM sequence: TTG
ggctgcaagggcagagaagg

SEQ ID NO: 15549 - DNA, 20 bp, Artificial Sequence
  Description of Artificial Sequence: Synthetic oligonucleotide
  Target: SOD1; (+) strand; PAM type: YTN; PAM sequence: CTG
caagggcagagaaggtagcc

SEQ ID NO: 15550 - DNA, 20 bp, Artificial Sequence
  Description of Artificial Sequence: Synthetic oligonucleotide
  Target: SOD1; (+) strand; PAM type: YTN; PAM sequence: CTT
gaacagaggtccttttcctc

SEQ ID NO: 15551 - DNA, 20 bp, Artificial Sequence
  Description of Artificial Sequence: Synthetic oligonucleotide
  Target: SOD1; (+) strand; PAM type: YTN; PAM sequence: TTG
aacagaggtccttttcctcc

SEQ ID NO: 15552 - DNA, 20 bp, Artificial Sequence
  Description of Artificial Sequence: Synthetic oligonucleotide
  Target: SOD1; (+) strand; PAM type: YTN; PAM sequence: CTT
ttcctcctcctaagctccgg

SEQ ID NO: 15553 - DNA, 20 bp, Artificial Sequence
  Description of Artificial Sequence: Synthetic oligonucleotide
  Target: SOD1; (+) strand; PAM type: YTN; PAM sequence: TTT
tcctcctcctaagctccggg

SEQ ID NO: 15554 - DNA, 20 bp, Artificial Sequence
  Description of Artificial Sequence: Synthetic oligonucleotide
  Target: SOD1; (+) strand; PAM type: YTN; PAM sequence: TTT
cctcctcctaagctccggga

SEQ ID NO: 15555 - DNA, 20 bp, Artificial Sequence
  Description of Artificial Sequence: Synthetic oligonucleotide
  Target: SOD1; (+) strand; PAM type: YTN; PAM sequence: TTC
ctcctcctaagctccgggag

SEQ ID NO: 15556 - DNA, 20 bp, Artificial Sequence
  Description of Artificial Sequence: Synthetic oligonucleotide
  Target: SOD1; (+) strand; PAM type: YTN; PAM sequence: CTC
ctcctaagctccgggagcca

SEQ ID NO: 15557 - DNA, 20 bp, Artificial Sequence
  Description of Artificial Sequence: Synthetic oligonucleotide
  Target: SOD1; (+) strand; PAM type: YTN; PAM sequence: CTC
ctaagctccgggagccagag

SEQ ID NO: 15558 - DNA, 20 bp, Artificial Sequence
  Description of Artificial Sequence: Synthetic oligonucleotide
  Target: SOD1; (+) strand; PAM type: YTN; PAM sequence: CTA
agctccgggagccagaggtt

SEQ ID NO: 15559 - DNA, 20 bp, Artificial Sequence
  Description of Artificial Sequence: Synthetic oligonucleotide
  Target: SOD1; (+) strand; PAM type: YTN; PAM sequence: CTC
cgggagccagaggtttaact

SEQ ID NO: 15560 - DNA, 20 bp, Artificial Sequence
  Description of Artificial Sequence: Synthetic oligonucleotide
  Target: SOD1; (+) strand; PAM type: YTN; PAM sequence: TTT
aactgacccttttggggatt

SEQ ID NO: 15561 - DNA, 20 bp, Artificial Sequence
  Description of Artificial Sequence: Synthetic oligonucleotide
  Target: SOD1; (+) strand; PAM type: YTN; PAM sequence: TTA
actgacccttttggggattt

SEQ ID NO: 15562 - DNA, 20 bp, Artificial Sequence
  Description of Artificial Sequence: Synthetic oligonucleotide
  Target: SOD1; (+) strand; PAM type: YTN; PAM sequence: CTG
acccttttggggatttttga

SEQ ID NO: 15563 - DNA, 20 bp, Artificial Sequence
  Description of Artificial Sequence: Synthetic oligonucleotide
  Target: SOD1; (+) strand; PAM type: YTN; PAM sequence: CTT
ttggggatttttgagggcag

SEQ ID NO: 15564 - DNA, 20 bp, Artificial Sequence
  Description of Artificial Sequence: Synthetic oligonucleotide
  Target: SOD1; (+) strand; PAM type: YTN; PAM sequence: TTT
tggggatttttgagggcagt

SEQ ID NO: 15565 - DNA, 20 bp, Artificial Sequence
  Description of Artificial Sequence: Synthetic oligonucleotide
  Target: SOD1; (+) strand; PAM type: YTN; PAM sequence: TTT
ggggatttttgagggcagtg

SEQ ID NO: 15566 - DNA, 20 bp, Artificial Sequence
  Description of Artificial Sequence: Synthetic oligonucleotide
  Target: SOD1; (+) strand; PAM type: YTN; PAM sequence: TTG
gggatttttgagggcagtga

SEQ ID NO: 15567 - DNA, 20 bp, Artificial Sequence
  Description of Artificial Sequence: Synthetic oligonucleotide
  Target: SOD1; (+) strand; PAM type: YTN; PAM sequence: TTT
ttgagggcagtgatcttaac

SEQ ID NO: 15568 - DNA, 20 bp, Artificial Sequence
  Description of Artificial Sequence: Synthetic oligonucleotide
  Target: SOD1; (+) strand; PAM type: YTN; PAM sequence: TTT
tgagggcagtgatcttaact

SEQ ID NO: 15569 - DNA, 20 bp, Artificial Sequence
  Description of Artificial Sequence: Synthetic oligonucleotide
  Target: SOD1; (+) strand; PAM type: YTN; PAM sequence: TTT
gagggcagtgatcttaactt

SEQ ID NO: 15570 - DNA, 20 bp, Artificial Sequence
  Description of Artificial Sequence: Synthetic oligonucleotide
  Target: SOD1; (+) strand; PAM type: YTN; PAM sequence: TTG
agggcagtgatcttaacttt

SEQ ID NO: 15571 - DNA, 20 bp, Artificial Sequence
  Description of Artificial Sequence: Synthetic oligonucleotide
  Target: SOD1; (+) strand; PAM type: YTN; PAM sequence: CTT
aactttgggtgcacagttag

SEQ ID NO: 15572 - DNA, 20 bp, Artificial Sequence
  Description of Artificial Sequence: Synthetic oligonucleotide
  Target: SOD1; (+) strand; PAM type: YTN; PAM sequence: TTA
actttgggtgcacagttagc

SEQ ID NO: 15573 - DNA, 20 bp, Artificial Sequence
  Description of Artificial Sequence: Synthetic oligonucleotide
  Target: SOD1; (+) strand; PAM type: YTN; PAM sequence: CTT
tgggtgcacagttagcttat

SEQ ID NO: 15574 - DNA, 20 bp, Artificial Sequence
  Description of Artificial Sequence: Synthetic oligonucleotide
  Target: SOD1; (+) strand; PAM type: YTN; PAM sequence: TTT
gggtgcacagttagcttatt

SEQ ID NO: 15575 - DNA, 20 bp, Artificial Sequence
  Description of Artificial Sequence: Synthetic oligonucleotide
  Target: SOD1; (+) strand; PAM type: YTN; PAM sequence: TTG
ggtgcacagttagcttattt

SEQ ID NO: 15576 - DNA, 20 bp, Artificial Sequence
  Description of Artificial Sequence: Synthetic oligonucleotide
  Target: SOD1; (+) strand; PAM type: YTN; PAM sequence: TTA
gcttatttgaagatcttact

SEQ ID NO: 15577 - DNA, 20 bp, Artificial Sequence
  Description of Artificial Sequence: Synthetic oligonucleotide
  Target: SOD1; (+) strand; PAM type: YTN; PAM sequence: CTT
atttgaagatcttactaaaa

SEQ ID NO: 15578 - DNA, 20 bp, Artificial Sequence
  Description of Artificial Sequence: Synthetic oligonucleotide
  Target: SOD1; (+) strand; PAM type: YTN; PAM sequence: TTA
tttgaagatcttactaaaaa

SEQ ID NO: 15579 - DNA, 20 bp, Artificial Sequence
  Description of Artificial Sequence: Synthetic oligonucleotide
  Target: SOD1; (+) strand; PAM type: YTN; PAM sequence: TTT
gaagatcttactaaaaatac

SEQ ID NO: 15580 - DNA, 20 bp, Artificial Sequence
  Description of Artificial Sequence: Synthetic oligonucleotide
  Target: SOD1; (+) strand; PAM type: YTN; PAM sequence: TTG
aagatcttactaaaaataca

SEQ ID NO: 15581 - DNA, 20 bp, Artificial Sequence
  Description of Artificial Sequence: Synthetic oligonucleotide
  Target: SOD1; (+) strand; PAM type: YTN; PAM sequence: CTT
actaaaaatacaccagagcc

SEQ ID NO: 15582 - DNA, 20 bp, Artificial Sequence
  Description of Artificial Sequence: Synthetic oligonucleotide
  Target: SOD1; (+) strand; PAM type: YTN; PAM sequence: TTA
ctaaaaatacaccagagccc

SEQ ID NO: 15583 - DNA, 20 bp, Artificial Sequence
  Description of Artificial Sequence: Synthetic oligonucleotide
  Target: SOD1; (+) strand; PAM type: YTN; PAM sequence: CTA
aaaatacaccagagcccaac

SEQ ID NO: 15584 - DNA, 20 bp, Artificial Sequence
  Description of Artificial Sequence: Synthetic oligonucleotide
  Target: SOD1; (+) strand; PAM type: YTN; PAM sequence: CTC
cgaccaattacatcaaaacc

SEQ ID NO: 15585 - DNA, 20 bp, Artificial Sequence
  Description of Artificial Sequence: Synthetic oligonucleotide
  Target: SOD1; (+) strand; PAM type: YTN; PAM sequence: TTA
catcaaaacctgtcctagtg

SEQ ID NO: 15586 - DNA, 20 bp, Artificial Sequence
  Description of Artificial Sequence: Synthetic oligonucleotide
  Target: SOD1; (+) strand; PAM type: YTN; PAM sequence: CTG
tcctagtgcagggtgagtat

SEQ ID NO: 15587 - DNA, 20 bp, Artificial Sequence
  Description of Artificial Sequence: Synthetic oligonucleotide
  Target: SOD1; (+) strand; PAM type: YTN; PAM sequence: CTA
gtgcagggtgagtattgctg

SEQ ID NO: 15588 - DNA, 20 bp, Artificial Sequence
  Description of Artificial Sequence: Synthetic oligonucleotide
  Target: SOD1; (+) strand; PAM type: YTN; PAM sequence: TTG
ctgttttttgaaagtttcca

SEQ ID NO: 15589 - DNA, 20 bp, Artificial Sequence
  Description of Artificial Sequence: Synthetic oligonucleotide
  Target: SOD1; (+) strand; PAM type: YTN; PAM sequence: CTG
ttttttgaaagtttccaaaa

SEQ ID NO: 15590 - DNA, 20 bp, Artificial Sequence
  Description of Artificial Sequence: Synthetic oligonucleotide
  Target: SOD1; (+) strand; PAM type: YTN; PAM sequence: TTT
tttgaaagtttccaaaagtg

SEQ ID NO: 15591 - DNA, 20 bp, Artificial Sequence
  Description of Artificial Sequence: Synthetic oligonucleotide
  Target: SOD1; (+) strand; PAM type: YTN; PAM sequence: TTT
ttgaaagtttccaaaagtga

SEQ ID NO: 15592 - DNA, 20 bp, Artificial Sequence
  Description of Artificial Sequence: Synthetic oligonucleotide
  Target: SOD1; (+) strand; PAM type: YTN; PAM sequence: TTT
tgaaagtttccaaaagtgat

SEQ ID NO: 15593 - DNA, 20 bp, Artificial Sequence
  Description of Artificial Sequence: Synthetic oligonucleotide
  Target: SOD1; (+) strand; PAM type: YTN; PAM sequence: TTT
gaaagtttccaaaagtgatt

SEQ ID NO: 15594 - DNA, 20 bp, Artificial Sequence
  Description of Artificial Sequence: Synthetic oligonucleotide
  Target: SOD1; (+) strand; PAM type: YTN; PAM sequence: TTG
aaagtttccaaaagtgattt

SEQ ID NO: 15595 - DNA, 20 bp, Artificial Sequence
  Description of Artificial Sequence: Synthetic oligonucleotide
  Target: SOD1; (+) strand; PAM type: YTN; PAM sequence: TTT
ccaaaagtgattttgatgtg

SEQ ID NO: 15596 - DNA, 20 bp, Artificial Sequence
  Description of Artificial Sequence: Synthetic oligonucleotide
  Target: SOD1; (+) strand; PAM type: YTN; PAM sequence: TTC
caaaagtgattttgatgtgc

SEQ ID NO: 15597 - DNA, 20 bp, Artificial Sequence
  Description of Artificial Sequence: Synthetic oligonucleotide
  Target: SOD1; (+) strand; PAM type: YTN; PAM sequence: TTT
tgatgtgcacctacgattga

SEQ ID NO: 15598 - DNA, 20 bp, Artificial Sequence
  Description of Artificial Sequence: Synthetic oligonucleotide
  Target: SOD1; (+) strand; PAM type: YTN; PAM sequence: TTT
gatgtgcacctacgattgag

SEQ ID NO: 15599 - DNA, 20 bp, Artificial Sequence
  Description of Artificial Sequence: Synthetic oligonucleotide
  Target: SOD1; (+) strand; PAM type: YTN; PAM sequence: TTG
atgtgcacctacgattgaga

SEQ ID NO: 15600 - DNA, 20 bp, Artificial Sequence
  Description of Artificial Sequence: Synthetic oligonucleotide
  Target: SOD1; (+) strand; PAM type: YTN; PAM sequence: CTA
cgattgagaactgtcgtttg

SEQ ID NO: 15601 - DNA, 20 bp, Artificial Sequence
  Description of Artificial Sequence: Synthetic oligonucleotide
  Target: SOD1; (+) strand; PAM type: YTN; PAM sequence: TTG
agaactgtcgtttgaggaca

SEQ ID NO: 15602 - DNA, 20 bp, Artificial Sequence
  Description of Artificial Sequence: Synthetic oligonucleotide
  Target: SOD1; (+) strand; PAM type: YTN; PAM sequence: CTG
tcgtttgaggacagtgggtg

SEQ ID NO: 15603 - DNA, 20 bp, Artificial Sequence
  Description of Artificial Sequence: Synthetic oligonucleotide
  Target: SOD1; (+) strand; PAM type: YTN; PAM sequence: TTT
gaggacagtgggtggagttt

SEQ ID NO: 15604 - DNA, 20 bp, Artificial Sequence
  Description of Artificial Sequence: Synthetic oligonucleotide
  Target: SOD1; (+) strand; PAM type: YTN; PAM sequence: TTG
aggacagtgggtggagtttc

SEQ ID NO: 15605 - DNA, 20 bp, Artificial Sequence
  Description of Artificial Sequence: Synthetic oligonucleotide
  Target: SOD1; (+) strand; PAM type: YTN; PAM sequence: TTT
cgtatttggaaattagaaga

SEQ ID NO: 15606 - DNA, 20 bp, Artificial Sequence
  Description of Artificial Sequence: Synthetic oligonucleotide
  Target: SOD1; (+) strand; PAM type: YTN; PAM sequence: TTC
gtatttggaaattagaagac

SEQ ID NO: 15607 - DNA, 20 bp, Artificial Sequence
  Description of Artificial Sequence: Synthetic oligonucleotide
  Target: SOD1; (+) strand; PAM type: YTN; PAM sequence: TTT
ggaaattagaagacctggag

SEQ ID NO: 15608 - DNA, 20 bp, Artificial Sequence
  Description of Artificial Sequence: Synthetic oligonucleotide
  Target: SOD1; (+) strand; PAM type: YTN; PAM sequence: TTG
gaaattagaagacctggagt

SEQ ID NO: 15609 - DNA, 20 bp, Artificial Sequence
  Description of Artificial Sequence: Synthetic oligonucleotide
  Target: SOD1; (+) strand; PAM type: YTN; PAM sequence: TTA
gaagacctggagtttccatt

SEQ ID NO: 15610 - DNA, 20 bp, Artificial Sequence
  Description of Artificial Sequence: Synthetic oligonucleotide
  Target: SOD1; (+) strand; PAM type: YTN; PAM sequence: CTG
gagtttccattacaccgaat

SEQ ID NO: 15611 - DNA, 20 bp, Artificial Sequence
  Description of Artificial Sequence: Synthetic oligonucleotide
  Target: SOD1; (+) strand; PAM type: YTN; PAM sequence: TTT
ccattacaccgaattggcac

SEQ ID NO: 15612 - DNA, 20 bp, Artificial Sequence
  Description of Artificial Sequence: Synthetic oligonucleotide
  Target: SOD1; (+) strand; PAM type: YTN; PAM sequence: TTC
cattacaccgaattggcact

SEQ ID NO: 15613 - DNA, 20 bp, Artificial Sequence
  Description of Artificial Sequence: Synthetic oligonucleotide
  Target: SOD1; (+) strand; PAM type: YTN; PAM sequence: TTA
caccgaattggcacttaata

SEQ ID NO: 15614 - DNA, 20 bp, Artificial Sequence
  Description of Artificial Sequence: Synthetic oligonucleotide
  Target: SOD1; (+) strand; PAM type: YTN; PAM sequence: TTG
gcacttaataactgttgtcg

SEQ ID NO: 15615 - DNA, 20 bp, Artificial Sequence
  Description of Artificial Sequence: Synthetic oligonucleotide
  Target: SOD1; (+) strand; PAM type: YTN; PAM sequence: CTT
aataactgttgtcggagcat

SEQ ID NO: 15616 - DNA, 20 bp, Artificial Sequence
  Description of Artificial Sequence: Synthetic oligonucleotide
  Target: SOD1; (+) strand; PAM type: YTN; PAM sequence: TTA
ataactgttgtcggagcatt

SEQ ID NO: 15617 - DNA, 20 bp, Artificial Sequence
  Description of Artificial Sequence: Synthetic oligonucleotide
  Target: SOD1; (+) strand; PAM type: YTN; PAM sequence: CTG
ttgtcggagcatttcttaag

SEQ ID NO: 15618 - DNA, 20 bp, Artificial Sequence
  Description of Artificial Sequence: Synthetic oligonucleotide
  Target: SOD1; (+) strand; PAM type: YTN; PAM sequence: TTG
tcggagcatttcttaagcca

SEQ ID NO: 15619 - DNA, 20 bp, Artificial Sequence
  Description of Artificial Sequence: Synthetic oligonucleotide
  Target: SOD1; (+) strand; PAM type: YTN; PAM sequence: TTT
cttaagccacattttcgtaa

SEQ ID NO: 15620 - DNA, 20 bp, Artificial Sequence
  Description of Artificial Sequence: Synthetic oligonucleotide
  Target: SOD1; (+) strand; PAM type: YTN; PAM sequence: TTC
ttaagccacattttcgtaaa

SEQ ID NO: 15621 - DNA, 20 bp, Artificial Sequence
  Description of Artificial Sequence: Synthetic oligonucleotide
  Target: SOD1; (+) strand; PAM type: YTN; PAM sequence: CTT
aagccacattttcgtaaagt

SEQ ID NO: 15622 - DNA, 20 bp, Artificial Sequence
  Description of Artificial Sequence: Synthetic oligonucleotide
  Target: SOD1; (+) strand; PAM type: YTN; PAM sequence: TTA
agccacattttcgtaaagtg

SEQ ID NO: 15623 - DNA, 20 bp, Artificial Sequence
  Description of Artificial Sequence: Synthetic oligonucleotide
  Target: SOD1; (+) strand; PAM type: YTN; PAM sequence: TTT
tcgtaaagtggctttaaaat

SEQ ID NO: 15624 - DNA, 20 bp, Artificial Sequence
  Description of Artificial Sequence: Synthetic oligonucleotide
  Target: SOD1; (+) strand; PAM type: YTN; PAM sequence: TTT
cgtaaagtggctttaaaatt

SEQ ID NO: 15625 - DNA, 20 bp, Artificial Sequence
  Description of Artificial Sequence: Synthetic oligonucleotide
  Target: SOD1; (+) strand; PAM type: YTN; PAM sequence: TTC
gtaaagtggctttaaaattg

SEQ ID NO: 15626 - DNA, 20 bp, Artificial Sequence
  Description of Artificial Sequence: Synthetic oligonucleotide
  Target: SOD1; (+) strand; PAM type: YTN; PAM sequence: CTT
taaaattgctctgccagtag

SEQ ID NO: 15627 - DNA, 20 bp, Artificial Sequence
  Description of Artificial Sequence: Synthetic oligonucleotide
  Target: SOD1; (+) strand; PAM type: YTN; PAM sequence: TTT
aaaattgctctgccagtagg

SEQ ID NO: 15628 - DNA, 20 bp, Artificial Sequence
  Description of Artificial Sequence: Synthetic oligonucleotide
  Target: SOD1; (+) strand; PAM type: YTN; PAM sequence: TTA
aaattgctctgccagtaggc

SEQ ID NO: 15629 - DNA, 20 bp, Artificial Sequence
  Description of Artificial Sequence: Synthetic oligonucleotide
  Target: SOD1; (+) strand; PAM type: YTN; PAM sequence: TTG
ctctgccagtaggcaggttg

SEQ ID NO: 15630 - DNA, 20 bp, Artificial Sequence
  Description of Artificial Sequence: Synthetic oligonucleotide
  Target: SOD1; (+) strand; PAM type: YTN; PAM sequence: CTC
tgccagtaggcaggttgcta

SEQ ID NO: 15631 - DNA, 20 bp, Artificial Sequence
  Description of Artificial Sequence: Synthetic oligonucleotide
  Target: SOD1; (+) strand; PAM type: YTN; PAM sequence: CTG
ccagtaggcaggttgctaag

SEQ ID NO: 15632 - DNA, 20 bp, Artificial Sequence
  Description of Artificial Sequence: Synthetic oligonucleotide
  Target: SOD1; (+) strand; PAM type: YTN; PAM sequence: TTG
ctaagatggtcagagacaaa

SEQ ID NO: 15633 - DNA, 20 bp, Artificial Sequence
  Description of Artificial Sequence: Synthetic oligonucleotide
  Target: SOD1; (+) strand; PAM type: YTN; PAM sequence: CTA
agatggtcagagacaaactt

SEQ ID NO: 15634 - DNA, 20 bp, Artificial Sequence
  Description of Artificial Sequence: Synthetic oligonucleotide
  Target: SOD1; (+) strand; PAM type: YTN; PAM sequence: CTT
ctgaacgactcttgtaaaat

SEQ ID NO: 15635 - DNA, 20 bp, Artificial Sequence
  Description of Artificial Sequence: Synthetic oligonucleotide
  Target: SOD1; (+) strand; PAM type: YTN; PAM sequence: TTC
tgaacgactcttgtaaaata

SEQ ID NO: 15636 - DNA, 20 bp, Artificial Sequence
  Description of Artificial Sequence: Synthetic oligonucleotide
  Target: SOD1; (+) strand; PAM type: YTN; PAM sequence: CTG
aacgactcttgtaaaatata

SEQ ID NO: 15637 - DNA, 20 bp, Artificial Sequence
  Description of Artificial Sequence: Synthetic oligonucleotide
  Target: SOD1; (+) strand; PAM type: YTN; PAM sequence: CTC
ttgtaaaatatacagaaata

SEQ ID NO: 15638 - DNA, 20 bp, Artificial Sequence
  Description of Artificial Sequence: Synthetic oligonucleotide
  Target: SOD1; (+) strand; PAM type: YTN; PAM sequence: CTT
gtaaaatatacagaaatatt

SEQ ID NO: 15639 - DNA, 20 bp, Artificial Sequence
  Description of Artificial Sequence: Synthetic oligonucleotide
  Target: SOD1; (+) strand; PAM type: YTN; PAM sequence: TTG
taaaatatacagaaatattt

SEQ ID NO: 15640 - DNA, 20 bp, Artificial Sequence
  Description of Artificial Sequence: Synthetic oligonucleotide
  Target: SOD1; (+) strand; PAM type: YTN; PAM sequence: TTT
tcagaacttttatcagtaaa

SEQ ID NO: 15641 - DNA, 20 bp, Artificial Sequence
  Description of Artificial Sequence: Synthetic oligonucleotide
  Target: SOD1; (+) strand; PAM type: YTN; PAM sequence: TTT
cagaacttttatcagtaaaa

SEQ ID NO: 15642 - DNA, 20 bp, Artificial Sequence
  Description of Artificial Sequence: Synthetic oligonucleotide
  Target: SOD1; (+) strand; PAM type: YTN; PAM sequence: TTC
agaacttttatcagtaaaat

SEQ ID NO: 15643 - DNA, 20 bp, Artificial Sequence
  Description of Artificial Sequence: Synthetic oligonucleotide
  Target: SOD1; (+) strand; PAM type: YTN; PAM sequence: CTT
ttatcagtaaaattacaaaa

SEQ ID NO: 15644 - DNA, 20 bp, Artificial Sequence
  Description of Artificial Sequence: Synthetic oligonucleotide
  Target: SOD1; (+) strand; PAM type: YTN; PAM sequence: TTT
tatcagtaaaattacaaaac

SEQ ID NO: 15645 - DNA, 20 bp, Artificial Sequence
  Description of Artificial Sequence: Synthetic oligonucleotide
  Target: SOD1; (+) strand; PAM type: YTN; PAM sequence: TTT
atcagtaaaattacaaaacg

SEQ ID NO: 15646 - DNA, 20 bp, Artificial Sequence
  Description of Artificial Sequence: Synthetic oligonucleotide
  Target: SOD1; (+) strand; PAM type: YTN; PAM sequence: TTA
tcagtaaaattacaaaacgt

SEQ ID NO: 15647 - DNA, 20 bp, Artificial Sequence
  Description of Artificial Sequence: Synthetic oligonucleotide
  Target: SOD1; (+) strand; PAM type: YTN; PAM sequence: TTA
caaaacgtgttgcaaggaag

SEQ ID NO: 15648 - DNA, 20 bp, Artificial Sequence
  Description of Artificial Sequence: Synthetic oligonucleotide
  Target: SOD1; (+) strand; PAM type: YTN; PAM sequence: TTG
caaggaaggtgcttgtgata

SEQ ID NO: 15649 - DNA, 20 bp, Artificial Sequence
  Description of Artificial Sequence: Synthetic oligonucleotide
  Target: SOD1; (+) strand; PAM type: YTN; PAM sequence: CTT
gtgataacactgtccccaga

SEQ ID NO: 15650 - DNA, 20 bp, Artificial Sequence
  Description of Artificial Sequence: Synthetic oligonucleotide
  Target: SOD1; (+) strand; PAM type: YTN; PAM sequence: TTG
tgataacactgtccccagaa

SEQ ID NO: 15651 - DNA, 20 bp, Artificial Sequence
  Description of Artificial Sequence: Synthetic oligonucleotide
  Target: SOD1; (+) strand; PAM type: YTN; PAM sequence: CTG
tccccagaaccttagtgaag

SEQ ID NO: 15652 - DNA, 20 bp, Artificial Sequence
  Description of Artificial Sequence: Synthetic oligonucleotide
  Target: SOD1; (+) strand; PAM type: YTN; PAM sequence: CTT
agtgaagttaccaactggtg

SEQ ID NO: 15653 - DNA, 20 bp, Artificial Sequence
  Description of Artificial Sequence: Synthetic oligonucleotide
  Target: SOD1; (+) strand; PAM type: YTN; PAM sequence: TTA
gtgaagttaccaactggtgg

SEQ ID NO: 15654 - DNA, 20 bp, Artificial Sequence
  Description of Artificial Sequence: Synthetic oligonucleotide
  Target: SOD1; (+) strand; PAM type: YTN; PAM sequence: TTA
ccaactggtggaaaattttc

SEQ ID NO: 15655 - DNA, 20 bp, Artificial Sequence
  Description of Artificial Sequence: Synthetic oligonucleotide
  Target: SOD1; (+) strand; PAM type: YTN; PAM sequence: CTG
gtggaaaattttctcttgca

SEQ ID NO: 15656 - DNA, 20 bp, Artificial Sequence
  Description of Artificial Sequence: Synthetic oligonucleotide
  Target: SOD1; (+) strand; PAM type: YTN; PAM sequence: TTT
tctcttgcactcggcttaaa

SEQ ID NO: 15657 - DNA, 20 bp, Artificial Sequence
  Description of Artificial Sequence: Synthetic oligonucleotide
  Target: SOD1; (+) strand; PAM type: YTN; PAM sequence: TTT
ctcttgcactcggcttaaaa

SEQ ID NO: 15658 - DNA, 20 bp, Artificial Sequence
  Description of Artificial Sequence: Synthetic oligonucleotide
  Target: SOD1; (+) strand; PAM type: YTN; PAM sequence: TTC
tcttgcactcggcttaaaaa

SEQ ID NO: 15659 - DNA, 20 bp, Artificial Sequence
  Description of Artificial Sequence: Synthetic oligonucleotide
  Target: SOD1; (+) strand; PAM type: YTN; PAM sequence: CTC
ttgcactcggcttaaaaatc

SEQ ID NO: 15660 - DNA, 20 bp, Artificial Sequence
  Description of Artificial Sequence: Synthetic oligonucleotide
  Target: SOD1; (+) strand; PAM type: YTN; PAM sequence: CTT
gcactcggcttaaaaatcat

SEQ ID NO: 15661 - DNA, 20 bp, Artificial Sequence
  Description of Artificial Sequence: Synthetic oligonucleotide
  Target: SOD1; (+) strand; PAM type: YTN; PAM sequence: TTG
cactcggcttaaaaatcatg

SEQ ID NO: 15662 - DNA, 20 bp, Artificial Sequence
  Description of Artificial Sequence: Synthetic oligonucleotide
  Target: SOD1; (+) strand; PAM type: YTN; PAM sequence: CTC
ggcttaaaaatcatgaggga

SEQ ID NO: 15663 - DNA, 20 bp, Artificial Sequence
  Description of Artificial Sequence: Synthetic oligonucleotide
  Target: SOD1; (+) strand; PAM type: YTN; PAM sequence: CTT
aaaaatcatgagggaatatt

SEQ ID NO: 15664 - DNA, 20 bp, Artificial Sequence
  Description of Artificial Sequence: Synthetic oligonucleotide
  Target: SOD1; (+) strand; PAM type: YTN; PAM sequence: TTA
aaaatcatgagggaatattt

SEQ ID NO: 15665 - DNA, 20 bp, Artificial Sequence
  Description of Artificial Sequence: Synthetic oligonucleotide
  Target: SOD1; (+) strand; PAM type: YTN; PAM sequence: TTT
actatacgaatgagattcag

SEQ ID NO: 15666 - DNA, 20 bp, Artificial Sequence
  Description of Artificial Sequence: Synthetic oligonucleotide
  Target: SOD1; (+) strand; PAM type: YTN; PAM sequence: TTA
ctatacgaatgagattcagt

SEQ ID NO: 15667 - DNA, 20 bp, Artificial Sequence
  Description of Artificial Sequence: Synthetic oligonucleotide
  Target: SOD1; (+) strand; PAM type: YTN; PAM sequence: CTA
tacgaatgagattcagtctt

SEQ ID NO: 15668 - DNA, 20 bp, Artificial Sequence
  Description of Artificial Sequence: Synthetic oligonucleotide
  Target: SOD1; (+) strand; PAM type: YTN; PAM sequence: TTC
agtctttaaaggggtttaca

SEQ ID NO: 15669 - DNA, 20 bp, Artificial Sequence
  Description of Artificial Sequence: Synthetic oligonucleotide
  Target: SOD1; (+) strand; PAM type: YTN; PAM sequence: CTT
taaaggggtttacagaaacg

SEQ ID NO: 15670 - DNA, 20 bp, Artificial Sequence
  Description of Artificial Sequence: Synthetic oligonucleotide
  Target: SOD1; (+) strand; PAM type: YTN; PAM sequence: TTT
aaaggggtttacagaaacgt

SEQ ID NO: 15671 - DNA, 20 bp, Artificial Sequence
  Description of Artificial Sequence: Synthetic oligonucleotide
  Target: SOD1; (+) strand; PAM type: YTN; PAM sequence: TTA
aaggggtttacagaaacgtg

SEQ ID NO: 15672 - DNA, 20 bp, Artificial Sequence
  Description of Artificial Sequence: Synthetic oligonucleotide
  Target: SOD1; (+) strand; PAM type: YTN; PAM sequence: TTT
acagaaacgtgagaggacag

SEQ ID NO: 15673 - DNA, 20 bp, Artificial Sequence
  Description of Artificial Sequence: Synthetic oligonucleotide
  Target: SOD1; (+) strand; PAM type: YTN; PAM sequence: TTA
cagaaacgtgagaggacagg

SEQ ID NO: 15674 - DNA, 20 bp, Artificial Sequence
  Description of Artificial Sequence: Synthetic oligonucleotide
  Target: SOD1; (+) strand; PAM type: YTN; PAM sequence: TTA
gtctgtgtaaatgtctgaaa

SEQ ID NO: 15675 - DNA, 20 bp, Artificial Sequence
  Description of Artificial Sequence: Synthetic oligonucleotide
  Target: SOD1; (+) strand; PAM type: YTN; PAM sequence: CTG
tgtaaatgtctgaaatatat

SEQ ID NO: 15676 - DNA, 20 bp, Artificial Sequence
  Description of Artificial Sequence: Synthetic oligonucleotide
  Target: SOD1; (+) strand; PAM type: YTN; PAM sequence: CTG
aaatatatgtgagggagata

SEQ ID NO: 15677 - DNA, 20 bp, Artificial Sequence
  Description of Artificial Sequence: Synthetic oligonucleotide
  Target: SOD1; (+) strand; PAM type: YTN; PAM sequence: TTT
agcctttttctttaataggt

SEQ ID NO: 15678 - DNA, 20 bp, Artificial Sequence
  Description of Artificial Sequence: Synthetic oligonucleotide
  Target: SOD1; (+) strand; PAM type: YTN; PAM sequence: TTA
gcctttttctttaataggtc

SEQ ID NO: 15679 - DNA, 20 bp, Artificial Sequence
  Description of Artificial Sequence: Synthetic oligonucleotide
  Target: SOD1; (+) strand; PAM type: YTN; PAM sequence: CTT
tttctttaataggtctccag

SEQ ID NO: 15680 - DNA, 20 bp, Artificial Sequence
  Description of Artificial Sequence: Synthetic oligonucleotide
  Target: SOD1; (+) strand; PAM type: YTN; PAM sequence: TTT
ttctttaataggtctccaga

SEQ ID NO: 15681 - DNA, 20 bp, Artificial Sequence
  Description of Artificial Sequence: Synthetic oligonucleotide
  Target: SOD1; (+) strand; PAM type: YTN; PAM sequence: TTT
tctttaataggtctccagat

SEQ ID NO: 15682 - DNA, 20 bp, Artificial Sequence
  Description of Artificial Sequence: Synthetic oligonucleotide
  Target: SOD1; (+) strand; PAM type: YTN; PAM sequence: TTT
ctttaataggtctccagatt

SEQ ID NO: 15683 - DNA, 20 bp, Artificial Sequence
  Description of Artificial Sequence: Synthetic oligonucleotide
  Target: SOD1; (+) strand; PAM type: YTN; PAM sequence: TTC
tttaataggtctccagattt

SEQ ID NO: 15684 - DNA, 20 bp, Artificial Sequence
  Description of Artificial Sequence: Synthetic oligonucleotide
  Target: SOD1; (+) strand; PAM type: YTN; PAM sequence: CTT
taataggtctccagattttc

SEQ ID NO: 15685 - DNA, 20 bp, Artificial Sequence
  Description of Artificial Sequence: Synthetic oligonucleotide
  Target: SOD1; (+) strand; PAM type: YTN; PAM sequence: TTT
aataggtctccagattttct

SEQ ID NO: 15686 - DNA, 20 bp, Artificial Sequence
  Description of Artificial Sequence: Synthetic oligonucleotide
  Target: SOD1; (+) strand; PAM type: YTN; PAM sequence: TTA
ataggtctccagattttctg

SEQ ID NO: 15687 - DNA, 20 bp, Artificial Sequence
  Description of Artificial Sequence: Synthetic oligonucleotide
  Target: SOD1; (+) strand; PAM type: YTN; PAM sequence: CTC
cagattttctggaaaaggtt

SEQ ID NO: 15688 - DNA, 20 bp, Artificial Sequence
  Description of Artificial Sequence: Synthetic oligonucleotide
  Target: SOD1; (+) strand; PAM type: YTN; PAM sequence: TTT
tctggaaaaggttctttggc

SEQ ID NO: 15689 - DNA, 20 bp, Artificial Sequence
  Description of Artificial Sequence: Synthetic oligonucleotide
  Target: SOD1; (+) strand; PAM type: YTN; PAM sequence: TTT
ctggaaaaggttctttggca

SEQ ID NO: 15690 - DNA, 20 bp, Artificial Sequence
  Description of Artificial Sequence: Synthetic oligonucleotide
  Target: SOD1; (+) strand; PAM type: YTN; PAM sequence: TTC
tggaaaaggttctttggcat

SEQ ID NO: 15691 - DNA, 20 bp, Artificial Sequence
  Description of Artificial Sequence: Synthetic oligonucleotide
  Target: SOD1; (+) strand; PAM type: YTN; PAM sequence: CTG
gaaaaggttctttggcattt

SEQ ID NO: 15692 - DNA, 20 bp, Artificial Sequence
  Description of Artificial Sequence: Synthetic oligonucleotide
  Target: SOD1; (+) strand; PAM type: YTN; PAM sequence: TTC
tttggcatttgactccattt

SEQ ID NO: 15693 - DNA, 20 bp, Artificial Sequence
  Description of Artificial Sequence: Synthetic oligonucleotide
  Target: SOD1; (+) strand; PAM type: YTN; PAM sequence: CTT
tggcatttgactccattttg

SEQ ID NO: 15694 - DNA, 20 bp, Artificial Sequence
  Description of Artificial Sequence: Synthetic oligonucleotide
  Target: SOD1; (+) strand; PAM type: YTN; PAM sequence: TTT
ggcatttgactccattttgc

SEQ ID NO: 15695 - DNA, 20 bp, Artificial Sequence
  Description of Artificial Sequence: Synthetic oligonucleotide
  Target: SOD1; (+) strand; PAM type: YTN; PAM sequence: TTG
gcatttgactccattttgct

SEQ ID NO: 15696 - DNA, 20 bp, Artificial Sequence
  Description of Artificial Sequence: Synthetic oligonucleotide
  Target: SOD1; (+) strand; PAM type: YTN; PAM sequence: TTT
gactccattttgctgtttca

SEQ ID NO: 15697 - DNA, 20 bp, Artificial Sequence
  Description of Artificial Sequence: Synthetic oligonucleotide
  Target: SOD1; (+) strand; PAM type: YTN; PAM sequence: TTG
actccattttgctgtttcat

SEQ ID NO: 15698 - DNA, 20 bp, Artificial Sequence
  Description of Artificial Sequence: Synthetic oligonucleotide
  Target: SOD1; (+) strand; PAM type: YTN; PAM sequence: CTC
cattttgctgtttcatttgt

SEQ ID NO: 15699 - DNA, 20 bp, Artificial Sequence
  Description of Artificial Sequence: Synthetic oligonucleotide
  Target: SOD1; (+) strand; PAM type: YTN; PAM sequence: TTT
tgctgtttcatttgtcagac

SEQ ID NO: 15700 - DNA, 20 bp, Artificial Sequence
  Description of Artificial Sequence: Synthetic oligonucleotide
  Target: SOD1; (+) strand; PAM type: YTN; PAM sequence: TTT
gctgtttcatttgtcagact

SEQ ID NO: 15701 - DNA, 20 bp, Artificial Sequence
  Description of Artificial Sequence: Synthetic oligonucleotide
  Target: SOD1; (+) strand; PAM type: YTN; PAM sequence: TTG
ctgtttcatttgtcagactt

SEQ ID NO: 15702 - DNA, 20 bp, Artificial Sequence
  Description of Artificial Sequence: Synthetic oligonucleotide
  Target: SOD1; (+) strand; PAM type: YTN; PAM sequence: CTG
tttcatttgtcagacttctt

SEQ ID NO: 15703 - DNA, 20 bp, Artificial Sequence
  Description of Artificial Sequence: Synthetic oligonucleotide
  Target: SOD1; (+) strand; PAM type: YTN; PAM sequence: TTT
catttgtcagacttcttttt

SEQ ID NO: 15704 - DNA, 20 bp, Artificial Sequence
  Description of Artificial Sequence: Synthetic oligonucleotide
  Target: SOD1; (+) strand; PAM type: YTN; PAM sequence: TTC
atttgtcagacttctttttg

SEQ ID NO: 15705 - DNA, 20 bp, Artificial Sequence
  Description of Artificial Sequence: Synthetic oligonucleotide
  Target: SOD1; (+) strand; PAM type: YTN; PAM sequence: TTT
gtcagacttctttttgtccc

SEQ ID NO: 15706 - DNA, 20 bp, Artificial Sequence
  Description of Artificial Sequence: Synthetic oligonucleotide
  Target: SOD1; (+) strand; PAM type: YTN; PAM sequence: TTG
tcagacttctttttgtccct

SEQ ID NO: 15707 - DNA, 20 bp, Artificial Sequence
  Description of Artificial Sequence: Synthetic oligonucleotide
  Target: SOD1; (+) strand; PAM type: YTN; PAM sequence: CTT
ctttttgtccctctttactt

SEQ ID NO: 15708 - DNA, 20 bp, Artificial Sequence
  Description of Artificial Sequence: Synthetic oligonucleotide
  Target: SOD1; (+) strand; PAM type: YTN; PAM sequence: TTC
tttttgtccctctttacttc

SEQ ID NO: 15709 - DNA, 20 bp, Artificial Sequence
  Description of Artificial Sequence: Synthetic oligonucleotide
  Target: SOD1; (+) strand; PAM type: YTN; PAM sequence: CTT
tttgtccctctttacttctc

SEQ ID NO: 15710 - DNA, 20 bp, Artificial Sequence
  Description of Artificial Sequence: Synthetic oligonucleotide
  Target: SOD1; (+) strand; PAM type: YTN; PAM sequence: TTT
ttgtccctctttacttctcc

SEQ ID NO: 15711 - DNA, 20 bp, Artificial Sequence
  Description of Artificial Sequence: Synthetic oligonucleotide
  Target: SOD1; (+) strand; PAM type: YTN; PAM sequence: TTT
tgtccctctttacttctccc

SEQ ID NO: 15712 - DNA, 20 bp, Artificial Sequence
  Description of Artificial Sequence: Synthetic oligonucleotide
  Target: SOD1; (+) strand; PAM type: YTN; PAM sequence: TTT
gtccctctttacttctcccc

SEQ ID NO: 15713 - DNA, 20 bp, Artificial Sequence
  Description of Artificial Sequence: Synthetic oligonucleotide
  Target: SOD1; (+) strand; PAM type: YTN; PAM sequence: TTG
tccctctttacttctcccca

SEQ ID NO: 15714 - DNA, 20 bp, Artificial Sequence
  Description of Artificial Sequence: Synthetic oligonucleotide
  Target: SOD1; (+) strand; PAM type: YTN; PAM sequence: CTC
tttacttctccccacataat

SEQ ID NO: 15715 - DNA, 20 bp, Artificial Sequence
  Description of Artificial Sequence: Synthetic oligonucleotide
  Target: SOD1; (+) strand; PAM type: YTN; PAM sequence: CTT
tacttctccccacataattc

SEQ ID NO: 15716 - DNA, 20 bp, Artificial Sequence
  Description of Artificial Sequence: Synthetic oligonucleotide
  Target: SOD1; (+) strand; PAM type: YTN; PAM sequence: TTT
acttctccccacataattca

SEQ ID NO: 15717 - DNA, 20 bp, Artificial Sequence
  Description of Artificial Sequence: Synthetic oligonucleotide
  Target: SOD1; (+) strand; PAM type: YTN; PAM sequence: TTA
cttctccccacataattcac

SEQ ID NO: 15718 - DNA, 20 bp, Artificial Sequence
  Description of Artificial Sequence: Synthetic oligonucleotide
  Target: SOD1; (+) strand; PAM type: YTN; PAM sequence: CTT
ctccccacataattcaccag

SEQ ID NO: 15719 - DNA, 20 bp, Artificial Sequence
  Description of Artificial Sequence: Synthetic oligonucleotide
  Target: SOD1; (+) strand; PAM type: YTN; PAM sequence: TTC
tccccacataattcaccagt

SEQ ID NO: 15720 - DNA, 20 bp, Artificial Sequence
  Description of Artificial Sequence: Synthetic oligonucleotide
  Target: SOD1; (+) strand; PAM type: YTN; PAM sequence: CTC
cccacataattcaccagtac

SEQ ID NO: 15721 - DNA, 20 bp, Artificial Sequence
  Description of Artificial Sequence: Synthetic oligonucleotide
  Target: SOD1; (+) strand; PAM type: YTN; PAM sequence: TTC
accagtactagtgttttgtt

SEQ ID NO: 15722 - DNA, 20 bp, Artificial Sequence
  Description of Artificial Sequence: Synthetic oligonucleotide
  Target: SOD1; (+) strand; PAM type: YTN; PAM sequence: CTA
gtgttttgtttttcagacca

SEQ ID NO: 15723 - DNA, 20 bp, Artificial Sequence
  Description of Artificial Sequence: Synthetic oligonucleotide
  Target: SOD1; (+) strand; PAM type: YTN; PAM sequence: TTT
tgtttttcagaccaagtctc

SEQ ID NO: 15724 - DNA, 20 bp, Artificial Sequence
  Description of Artificial Sequence: Synthetic oligonucleotide
  Target: SOD1; (+) strand; PAM type: YTN; PAM sequence: TTT
gtttttcagaccaagtctcg

SEQ ID NO: 15725 - DNA, 20 bp, Artificial Sequence
  Description of Artificial Sequence: Synthetic oligonucleotide
  Target: SOD1; (+) strand; PAM type: YTN; PAM sequence: TTG
tttttcagaccaagtctcgc

SEQ ID NO: 15726 - DNA, 20 bp, Artificial Sequence
  Description of Artificial Sequence: Synthetic oligonucleotide
  Target: SOD1; (+) strand; PAM type: YTN; PAM sequence: TTT
ttcagaccaagtctcgctct

SEQ ID NO: 15727 - DNA, 20 bp, Artificial Sequence
  Description of Artificial Sequence: Synthetic oligonucleotide
  Target: SOD1; (+) strand; PAM type: YTN; PAM sequence: TTT
tcagaccaagtctcgctctg

SEQ ID NO: 15728 - DNA, 20 bp, Artificial Sequence
  Description of Artificial Sequence: Synthetic oligonucleotide
  Target: SOD1; (+) strand; PAM type: YTN; PAM sequence: TTT
cagaccaagtctcgctctgt

SEQ ID NO: 15729 - DNA, 20 bp, Artificial Sequence
  Description of Artificial Sequence: Synthetic oligonucleotide
  Target: SOD1; (+) strand; PAM type: YTN; PAM sequence: TTC
agaccaagtctcgctctgtc

SEQ ID NO: 15730 - DNA, 20 bp, Artificial Sequence
  Description of Artificial Sequence: Synthetic oligonucleotide
  Target: SOD1; (+) strand; PAM type: YTN; PAM sequence: CTC
gctctgtcgcccaggctgga

SEQ ID NO: 15731 - DNA, 20 bp, Artificial Sequence
  Description of Artificial Sequence: Synthetic oligonucleotide
  Target: SOD1; (+) strand; PAM type: YTN; PAM sequence: CTC
tgtcgcccaggctggagtgc

SEQ ID NO: 15732 - DNA, 20 bp, Artificial Sequence
  Description of Artificial Sequence: Synthetic oligonucleotide
  Target: SOD1; (+) strand; PAM type: YTN; PAM sequence: CTG
tcgcccaggctggagtgcag

SEQ ID NO: 15733 - DNA, 20 bp, Artificial Sequence
  Description of Artificial Sequence: Synthetic oligonucleotide
  Target: SOD1; (+) strand; PAM type: YTN; PAM sequence: CTG
gagtgcagtggcgcgatctc

SEQ ID NO: 15734 - DNA, 20 bp, Artificial Sequence
  Description of Artificial Sequence: Synthetic oligonucleotide
  Target: SOD1; (+) strand; PAM type: YTN; PAM sequence: CTC
agctcactgcaacctccgcc

SEQ ID NO: 15735 - DNA, 20 bp, Artificial Sequence
  Description of Artificial Sequence: Synthetic oligonucleotide
  Target: SOD1; (+) strand; PAM type: YTN; PAM sequence: CTC
actgcaacctccgcctccca

SEQ ID NO: 15736 - DNA, 20 bp, Artificial Sequence
  Description of Artificial Sequence: Synthetic oligonucleotide
  Target: SOD1; (+) strand; PAM type: YTN; PAM sequence: CTG
caacctccgcctcccaggtt

SEQ ID NO: 15737 - DNA, 20 bp, Artificial Sequence
  Description of Artificial Sequence: Synthetic oligonucleotide
  Target: SOD1; (+) strand; PAM type: YTN; PAM sequence: CTC
cgcctcccaggttcaagcaa

SEQ ID NO: 15738 - DNA, 20 bp, Artificial Sequence
  Description of Artificial Sequence: Synthetic oligonucleotide
  Target: SOD1; (+) strand; PAM type: YTN; PAM sequence: CTC
ccaggttcaagcaattctcc

SEQ ID NO: 15739 - DNA, 20 bp, Artificial Sequence
  Description of Artificial Sequence: Synthetic oligonucleotide
  Target: SOD1; (+) strand; PAM type: YTN; PAM sequence: TTC
aagcaattctcctgcctcag

SEQ ID NO: 15740 - DNA, 20 bp, Artificial Sequence
  Description of Artificial Sequence: Synthetic oligonucleotide
  Target: SOD1; (+) strand; PAM type: YTN; PAM sequence: TTC
tcctgcctcagcctcccggg

SEQ ID NO: 15741 - DNA, 20 bp, Artificial Sequence
  Description of Artificial Sequence: Synthetic oligonucleotide
  Target: SOD1; (+) strand; PAM type: YTN; PAM sequence: CTC
ctgcctcagcctcccgggta

SEQ ID NO: 15742 - DNA, 20 bp, Artificial Sequence
  Description of Artificial Sequence: Synthetic oligonucleotide
  Target: SOD1; (+) strand; PAM type: YTN; PAM sequence: CTG
cctcagcctcccgggtagct

SEQ ID NO: 15743 - DNA, 20 bp, Artificial Sequence
  Description of Artificial Sequence: Synthetic oligonucleotide
  Target: SOD1; (+) strand; PAM type: YTN; PAM sequence: CTC
agcctcccgggtagctggga

SEQ ID NO: 15744 - DNA, 20 bp, Artificial Sequence
  Description of Artificial Sequence: Synthetic oligonucleotide
  Target: SOD1; (+) strand; PAM type: YTN; PAM sequence: CTC
ccgggtagctgggactacag

SEQ ID NO: 15745 - DNA, 20 bp, Artificial Sequence
  Description of Artificial Sequence: Synthetic oligonucleotide
  Target: SOD1; (+) strand; PAM type: YTN; PAM sequence: CTG
ggactacaggcgcgcgccgc

SEQ ID NO: 15746 - DNA, 20 bp, Artificial Sequence
  Description of Artificial Sequence: Synthetic oligonucleotide
  Target: SOD1; (+) strand; PAM type: YTN; PAM sequence: CTA
caggcgcgcgccgccacgcc

SEQ ID NO: 15747 - DNA, 20 bp, Artificial Sequence
  Description of Artificial Sequence: Synthetic oligonucleotide
  Target: SOD1; (+) strand; PAM type: YTN; PAM sequence: CTG
gctaattttttatattttag

SEQ ID NO: 15748 - DNA, 20 bp, Artificial Sequence
  Description of Artificial Sequence: Synthetic oligonucleotide
  Target: SOD1; (+) strand; PAM type: YTN; PAM sequence: CTA
attttttatattttagtaga

SEQ ID NO: 15749 - DNA, 20 bp, Artificial Sequence
  Description of Artificial Sequence: Synthetic oligonucleotide
  Target: SOD1; (+) strand; PAM type: YTN; PAM sequence: TTT
tttatattttagtagagacg

SEQ ID NO: 15750 - DNA, 20 bp, Artificial Sequence
  Description of Artificial Sequence: Synthetic oligonucleotide
  Target: SOD1; (+) strand; PAM type: YTN; PAM sequence: TTT
ttatattttagtagagacgg

SEQ ID NO: 15751 - DNA, 20 bp, Artificial Sequence
  Description of Artificial Sequence: Synthetic oligonucleotide
  Target: SOD1; (+) strand; PAM type: YTN; PAM sequence: TTT
tatattttagtagagacggc

SEQ ID NO: 15752 - DNA, 20 bp, Artificial Sequence
  Description of Artificial Sequence: Synthetic oligonucleotide
  Target: SOD1; (+) strand; PAM type: YTN; PAM sequence: TTT
atattttagtagagacggcg

SEQ ID NO: 15753 - DNA, 20 bp, Artificial Sequence
  Description of Artificial Sequence: Synthetic oligonucleotide
  Target: SOD1; (+) strand; PAM type: YTN; PAM sequence: TTA
tattttagtagagacggcgt

SEQ ID NO: 15754 - DNA, 20 bp, Artificial Sequence
  Description of Artificial Sequence: Synthetic oligonucleotide
  Target: SOD1; (+) strand; PAM type: YTN; PAM sequence: TTT
tagtagagacggcgtttcac

SEQ ID NO: 15755 - DNA, 20 bp, Artificial Sequence
  Description of Artificial Sequence: Synthetic oligonucleotide
  Target: SOD1; (+) strand; PAM type: YTN; PAM sequence: TTT
agtagagacggcgtttcacc

SEQ ID NO: 15756 - DNA, 20 bp, Artificial Sequence
  Description of Artificial Sequence: Synthetic oligonucleotide
  Target: SOD1; (+) strand; PAM type: YTN; PAM sequence: TTA
gtagagacggcgtttcacca

SEQ ID NO: 15757 - DNA, 20 bp, Artificial Sequence
  Description of Artificial Sequence: Synthetic oligonucleotide
  Target: SOD1; (+) strand; PAM type: YTN; PAM sequence: TTT
caccatgttggccaggatgg

SEQ ID NO: 15758 - DNA, 20 bp, Artificial Sequence
  Description of Artificial Sequence: Synthetic oligonucleotide
  Target: SOD1; (+) strand; PAM type: YTN; PAM sequence: TTC
accatgttggccaggatggt

SEQ ID NO: 15759 - DNA, 20 bp, Artificial Sequence
  Description of Artificial Sequence: Synthetic oligonucleotide
  Target: SOD1; (+) strand; PAM type: YTN; PAM sequence: TTG
gccaggatggtctcgatctg

SEQ ID NO: 15760 - DNA, 20 bp, Artificial Sequence
  Description of Artificial Sequence: Synthetic oligonucleotide
  Target: SOD1; (+) strand; PAM type: YTN; PAM sequence: CTC
gatctgttgacgtcgtgatc

SEQ ID NO: 15761 - DNA, 20 bp, Artificial Sequence
  Description of Artificial Sequence: Synthetic oligonucleotide
  Target: SOD1; (+) strand; PAM type: YTN; PAM sequence: CTG
ttgacgtcgtgatccacccg

SEQ ID NO: 15762 - DNA, 20 bp, Artificial Sequence
  Description of Artificial Sequence: Synthetic oligonucleotide
  Target: SOD1; (+) strand; PAM type: YTN; PAM sequence: TTG
acgtcgtgatccacccgcct

SEQ ID NO: 15763 - DNA, 20 bp, Artificial Sequence
  Description of Artificial Sequence: Synthetic oligonucleotide
  Target: SOD1; (+) strand; PAM type: YTN; PAM sequence: CTC
ggcctcccaaagtgctggga

SEQ ID NO: 15764 - DNA, 20 bp, Artificial Sequence
  Description of Artificial Sequence: Synthetic oligonucleotide
  Target: SOD1; (+) strand; PAM type: YTN; PAM sequence: CTC
ccaaagtgctgggattacag

SEQ ID NO: 15765 - DNA, 20 bp, Artificial Sequence
  Description of Artificial Sequence: Synthetic oligonucleotide
  Target: SOD1; (+) strand; PAM type: YTN; PAM sequence: CTG
ggattacaggcgtgagccac

SEQ ID NO: 15766 - DNA, 20 bp, Artificial Sequence
  Description of Artificial Sequence: Synthetic oligonucleotide
  Target: SOD1; (+) strand; PAM type: YTN; PAM sequence: TTA
caggcgtgagccaccccgcc

SEQ ID NO: 15767 - DNA, 20 bp, Artificial Sequence
  Description of Artificial Sequence: Synthetic oligonucleotide
  Target: SOD1; (+) strand; PAM type: YTN; PAM sequence: CTA
ttcttaagacgcctctgagg

SEQ ID NO: 15768 - DNA, 20 bp, Artificial Sequence
  Description of Artificial Sequence: Synthetic oligonucleotide
  Target: SOD1; (+) strand; PAM type: YTN; PAM sequence: TTC
ttaagacgcctctgaggaat

SEQ ID NO: 15769 - DNA, 20 bp, Artificial Sequence
  Description of Artificial Sequence: Synthetic oligonucleotide
  Target: SOD1; (+) strand; PAM type: YTN; PAM sequence: CTT
aagacgcctctgaggaatcc

SEQ ID NO: 15770 - DNA, 20 bp, Artificial Sequence
  Description of Artificial Sequence: Synthetic oligonucleotide
  Target: SOD1; (+) strand; PAM type: YTN; PAM sequence: TTA
agacgcctctgaggaatccc

SEQ ID NO: 15771 - DNA, 20 bp, Artificial Sequence
  Description of Artificial Sequence: Synthetic oligonucleotide
  Target: SOD1; (+) strand; PAM type: YTN; PAM sequence: CTC
tgaggaatcccttctccctg

SEQ ID NO: 15772 - DNA, 20 bp, Artificial Sequence
  Description of Artificial Sequence: Synthetic oligonucleotide
  Target: SOD1; (+) strand; PAM type: YTN; PAM sequence: CTG
aggaatcccttctccctggc

SEQ ID NO: 15773 - DNA, 20 bp, Artificial Sequence
  Description of Artificial Sequence: Synthetic oligonucleotide
  Target: SOD1; (+) strand; PAM type: YTN; PAM sequence: CTT
ctccctggccattgagaatc

SEQ ID NO: 15774 - DNA, 20 bp, Artificial Sequence
  Description of Artificial Sequence: Synthetic oligonucleotide
  Target: SOD1; (+) strand; PAM type: YTN; PAM sequence: TTC
tccctggccattgagaatcc

SEQ ID NO: 15775 - DNA, 20 bp, Artificial Sequence
  Description of Artificial Sequence: Synthetic oligonucleotide
  Target: SOD1; (+) strand; PAM type: YTN; PAM sequence: CTC
cctggccattgagaatccat

SEQ ID NO: 15776 - DNA, 20 bp, Artificial Sequence
  Description of Artificial Sequence: Synthetic oligonucleotide
  Target: SOD1; (+) strand; PAM type: YTN; PAM sequence: CTG
gccattgagaatccatgcat

SEQ ID NO: 15777 - DNA, 20 bp, Artificial Sequence
  Description of Artificial Sequence: Synthetic oligonucleotide
  Target: SOD1; (+) strand; PAM type: YTN; PAM sequence: TTG
agaatccatgcatgaaccca

SEQ ID NO: 15778 - DNA, 20 bp, Artificial Sequence
  Description of Artificial Sequence: Synthetic oligonucleotide
  Target: SOD1; (+) strand; PAM type: YTN; PAM sequence: TTT
tccaccttccctgagcagct

SEQ ID NO: 15779 - DNA, 20 bp, Artificial Sequence
  Description of Artificial Sequence: Synthetic oligonucleotide
  Target: SOD1; (+) strand; PAM type: YTN; PAM sequence: TTT
ccaccttccctgagcagctt

SEQ ID NO: 15780 - DNA, 20 bp, Artificial Sequence
  Description of Artificial Sequence: Synthetic oligonucleotide
  Target: SOD1; (+) strand; PAM type: YTN; PAM sequence: TTC
caccttccctgagcagcttg

SEQ ID NO: 15781 - DNA, 20 bp, Artificial Sequence
  Description of Artificial Sequence: Synthetic oligonucleotide
  Target: SOD1; (+) strand; PAM type: YTN; PAM sequence: CTT
ccctgagcagcttgcatagt

SEQ ID NO: 15782 - DNA, 20 bp, Artificial Sequence
  Description of Artificial Sequence: Synthetic oligonucleotide
  Target: SOD1; (+) strand; PAM type: YTN; PAM sequence: TTC
cctgagcagcttgcatagtt

SEQ ID NO: 15783 - DNA, 20 bp, Artificial Sequence
  Description of Artificial Sequence: Synthetic oligonucleotide
  Target: SOD1; (+) strand; PAM type: YTN; PAM sequence: CTG
agcagcttgcatagttcctt

SEQ ID NO: 15784 - DNA, 20 bp, Artificial Sequence
  Description of Artificial Sequence: Synthetic oligonucleotide
  Target: SOD1; (+) strand; PAM type: YTN; PAM sequence: CTT
gcatagttccttcttttaag

SEQ ID NO: 15785 - DNA, 20 bp, Artificial Sequence
  Description of Artificial Sequence: Synthetic oligonucleotide
  Target: SOD1; (+) strand; PAM type: YTN; PAM sequence: TTG
catagttccttcttttaagc

SEQ ID NO: 15786 - DNA, 20 bp, Artificial Sequence
  Description of Artificial Sequence: Synthetic oligonucleotide
  Target: SOD1; (+) strand; PAM type: YTN; PAM sequence: TTC
cttcttttaagcgcctgact

SEQ ID NO: 15787 - DNA, 20 bp, Artificial Sequence
  Description of Artificial Sequence: Synthetic oligonucleotide
  Target: SOD1; (+) strand; PAM type: YTN; PAM sequence: CTT
cttttaagcgcctgacttcg

SEQ ID NO: 15788 - DNA, 20 bp, Artificial Sequence
  Description of Artificial Sequence: Synthetic oligonucleotide
  Target: SOD1; (+) strand; PAM type: YTN; PAM sequence: TTC
ttttaagcgcctgacttcgt

SEQ ID NO: 15789 - DNA, 20 bp, Artificial Sequence
  Description of Artificial Sequence: Synthetic oligonucleotide
  Target: SOD1; (+) strand; PAM type: YTN; PAM sequence: CTT
ttaagcgcctgacttcgttt

SEQ ID NO: 15790 - DNA, 20 bp, Artificial Sequence
  Description of Artificial Sequence: Synthetic oligonucleotide
  Target: SOD1; (+) strand; PAM type: YTN; PAM sequence: TTT
taagcgcctgacttcgtttt

SEQ ID NO: 15791 - DNA, 20 bp, Artificial Sequence
  Description of Artificial Sequence: Synthetic oligonucleotide
  Target: SOD1; (+) strand; PAM type: YTN; PAM sequence: TTT
aagcgcctgacttcgttttg

SEQ ID NO: 15792 - DNA, 20 bp, Artificial Sequence
  Description of Artificial Sequence: Synthetic oligonucleotide
  Target: SOD1; (+) strand; PAM type: YTN; PAM sequence: TTA
agcgcctgacttcgttttgt

SEQ ID NO: 15793 - DNA, 20 bp, Artificial Sequence
  Description of Artificial Sequence: Synthetic oligonucleotide
  Target: SOD1; (+) strand; PAM type: YTN; PAM sequence: CTG
acttcgttttgtttggtgcc

SEQ ID NO: 15794 - DNA, 20 bp, Artificial Sequence
  Description of Artificial Sequence: Synthetic oligonucleotide
  Target: SOD1; (+) strand; PAM type: YTN; PAM sequence: CTT
cgttttgtttggtgcccgtt

SEQ ID NO: 15795 - DNA, 20 bp, Artificial Sequence
  Description of Artificial Sequence: Synthetic oligonucleotide
  Target: SOD1; (+) strand; PAM type: YTN; PAM sequence: TTC
gttttgtttggtgcccgttg

SEQ ID NO: 15796 - DNA, 20 bp, Artificial Sequence
  Description of Artificial Sequence: Synthetic oligonucleotide
  Target: SOD1; (+) strand; PAM type: YTN; PAM sequence: TTT
tgtttggtgcccgttgtacc

SEQ ID NO: 15797 - DNA, 20 bp, Artificial Sequence
  Description of Artificial Sequence: Synthetic oligonucleotide
  Target: SOD1; (+) strand; PAM type: YTN; PAM sequence: TTT
gtttggtgcccgttgtacct

SEQ ID NO: 15798 - DNA, 20 bp, Artificial Sequence
  Description of Artificial Sequence: Synthetic oligonucleotide
  Target: SOD1; (+) strand; PAM type: YTN; PAM sequence: TTG
tttggtgcccgttgtacctg

SEQ ID NO: 15799 - DNA, 20 bp, Artificial Sequence
  Description of Artificial Sequence: Synthetic oligonucleotide
  Target: SOD1; (+) strand; PAM type: YTN; PAM sequence: TTT
ggtgcccgttgtacctgaga

SEQ ID NO: 15800 - DNA, 20 bp, Artificial Sequence
  Description of Artificial Sequence: Synthetic oligonucleotide
  Target: SOD1; (+) strand; PAM type: YTN; PAM sequence: TTG
gtgcccgttgtacctgagaa

SEQ ID NO: 15801 - DNA, 20 bp, Artificial Sequence
  Description of Artificial Sequence: Synthetic oligonucleotide
  Target: SOD1; (+) strand; PAM type: YTN; PAM sequence: TTG
tacctgagaatgagccttgg

SEQ ID NO: 15802 - DNA, 20 bp, Artificial Sequence
  Description of Artificial Sequence: Synthetic oligonucleotide
  Target: SOD1; (+) strand; PAM type: YTN; PAM sequence: CTG
agaatgagccttggatagtg

SEQ ID NO: 15803 - DNA, 20 bp, Artificial Sequence
  Description of Artificial Sequence: Synthetic oligonucleotide
  Target: SOD1; (+) strand; PAM type: YTN; PAM sequence: CTT
ggatagtggagcattccagc

SEQ ID NO: 15804 - DNA, 20 bp, Artificial Sequence
  Description of Artificial Sequence: Synthetic oligonucleotide
  Target: SOD1; (+) strand; PAM type: YTN; PAM sequence: TTG
gatagtggagcattccagct

SEQ ID NO: 15805 - DNA, 20 bp, Artificial Sequence
  Description of Artificial Sequence: Synthetic oligonucleotide
  Target: SOD1; (+) strand; PAM type: YTN; PAM sequence: TTC
cagctttccagatatgcaga

SEQ ID NO: 15806 - DNA, 20 bp, Artificial Sequence
  Description of Artificial Sequence: Synthetic oligonucleotide
  Target: SOD1; (+) strand; PAM type: YTN; PAM sequence: CTT
tccagatatgcagagataat

SEQ ID NO: 15807 - DNA, 20 bp, Artificial Sequence
  Description of Artificial Sequence: Synthetic oligonucleotide
  Target: SOD1; (+) strand; PAM type: YTN; PAM sequence: TTT
ccagatatgcagagataata

SEQ ID NO: 15808 - DNA, 20 bp, Artificial Sequence
  Description of Artificial Sequence: Synthetic oligonucleotide
  Target: SOD1; (+) strand; PAM type: YTN; PAM sequence: TTC
cagatatgcagagataatac

SEQ ID NO: 15809 - DNA, 20 bp, Artificial Sequence
  Description of Artificial Sequence: Synthetic oligonucleotide
  Target: SOD1; (+) strand; PAM type: YTN; PAM sequence: TTG
gctatcagctacttggcttg

SEQ ID NO: 15810 - DNA, 20 bp, Artificial Sequence
  Description of Artificial Sequence: Synthetic oligonucleotide
  Target: SOD1; (+) strand; PAM type: YTN; PAM sequence: CTA
tcagctacttggcttggcct

SEQ ID NO: 15811 - DNA, 20 bp, Artificial Sequence
  Description of Artificial Sequence: Synthetic oligonucleotide
  Target: SOD1; (+) strand; PAM type: YTN; PAM sequence: CTA
cttggcttggcctattccgt

SEQ ID NO: 15812 - DNA, 20 bp, Artificial Sequence
  Description of Artificial Sequence: Synthetic oligonucleotide
  Target: SOD1; (+) strand; PAM type: YTN; PAM sequence: CTT
ggcttggcctattccgtgtt

SEQ ID NO: 15813 - DNA, 20 bp, Artificial Sequence
  Description of Artificial Sequence: Synthetic oligonucleotide
  Target: SOD1; (+) strand; PAM type: YTN; PAM sequence: TTG
gcttggcctattccgtgttt

SEQ ID NO: 15814 - DNA, 20 bp, Artificial Sequence
  Description of Artificial Sequence: Synthetic oligonucleotide
  Target: SOD1; (+) strand; PAM type: YTN; PAM sequence: CTT
ggcctattccgtgtttaaaa

SEQ ID NO: 15815 - DNA, 20 bp, Artificial Sequence
  Description of Artificial Sequence: Synthetic oligonucleotide
  Target: SOD1; (+) strand; PAM type: YTN; PAM sequence: TTG
gcctattccgtgtttaaaat

SEQ ID NO: 15816 - DNA, 20 bp, Artificial Sequence
  Description of Artificial Sequence: Synthetic oligonucleotide
  Target: SOD1; (+) strand; PAM type: YTN; PAM sequence: CTA
ttccgtgtttaaaatcttgg

SEQ ID NO: 15817 - DNA, 20 bp, Artificial Sequence
  Description of Artificial Sequence: Synthetic oligonucleotide
  Target: SOD1; (+) strand; PAM type: YTN; PAM sequence: TTC
cgtgtttaaaatcttggact

SEQ ID NO: 15818 - DNA, 20 bp, Artificial Sequence
  Description of Artificial Sequence: Synthetic oligonucleotide
  Target: SOD1; (+) strand; PAM type: YTN; PAM sequence: TTT
aaaatcttggactctttgct

SEQ ID NO: 15819 - DNA, 20 bp, Artificial Sequence
  Description of Artificial Sequence: Synthetic oligonucleotide
  Target: SOD1; (+) strand; PAM type: YTN; PAM sequence: TTA
aaatcttggactctttgcta

SEQ ID NO: 15820 - DNA, 20 bp, Artificial Sequence
  Description of Artificial Sequence: Synthetic oligonucleotide
  Target: SOD1; (+) strand; PAM type: YTN; PAM sequence: CTT
ggactctttgctagttttta

SEQ ID NO: 15821 - DNA, 20 bp, Artificial Sequence
  Description of Artificial Sequence: Synthetic oligonucleotide
  Target: SOD1; (+) strand; PAM type: YTN; PAM sequence: TTG
gactctttgctagtttttac

SEQ ID NO: 15822 - DNA, 20 bp, Artificial Sequence
  Description of Artificial Sequence: Synthetic oligonucleotide
  Target: SOD1; (+) strand; PAM type: YTN; PAM sequence: CTC
tttgctagtttttacagatc

SEQ ID NO: 15823 - DNA, 20 bp, Artificial Sequence
  Description of Artificial Sequence: Synthetic oligonucleotide
  Target: SOD1; (+) strand; PAM type: YTN; PAM sequence: CTT
tgctagtttttacagatcag

SEQ ID NO: 15824 - DNA, 20 bp, Artificial Sequence
  Description of Artificial Sequence: Synthetic oligonucleotide
  Target: SOD1; (+) strand; PAM type: YTN; PAM sequence: TTT
gctagtttttacagatcaga

SEQ ID NO: 15825 - DNA, 20 bp, Artificial Sequence
  Description of Artificial Sequence: Synthetic oligonucleotide
  Target: SOD1; (+) strand; PAM type: YTN; PAM sequence: TTG
ctagtttttacagatcagaa

SEQ ID NO: 15826 - DNA, 20 bp, Artificial Sequence
  Description of Artificial Sequence: Synthetic oligonucleotide
  Target: SOD1; (+) strand; PAM type: YTN; PAM sequence: CTA
gtttttacagatcagaattt

SEQ ID NO: 15827 - DNA, 20 bp, Artificial Sequence
  Description of Artificial Sequence: Synthetic oligonucleotide
  Target: SOD1; (+) strand; PAM type: YTN; PAM sequence: TTT
ttacagatcagaatttttca

SEQ ID NO: 15828 - DNA, 20 bp, Artificial Sequence
  Description of Artificial Sequence: Synthetic oligonucleotide
  Target: SOD1; (+) strand; PAM type: YTN; PAM sequence: TTT
tacagatcagaatttttcac

SEQ ID NO: 15829 - DNA, 20 bp, Artificial Sequence
  Description of Artificial Sequence: Synthetic oligonucleotide
  Target: SOD1; (+) strand; PAM type: YTN; PAM sequence: TTT
acagatcagaatttttcacg

SEQ ID NO: 15830 - DNA, 20 bp, Artificial Sequence
  Description of Artificial Sequence: Synthetic oligonucleotide
  Target: SOD1; (+) strand; PAM type: YTN; PAM sequence: TTA
cagatcagaatttttcacgt

SEQ ID NO: 15831 - DNA, 20 bp, Artificial Sequence
  Description of Artificial Sequence: Synthetic oligonucleotide
  Target: SOD1; (+) strand; PAM type: YTN; PAM sequence: TTT
ttcacgtattaatccagttt

SEQ ID NO: 15832 - DNA, 20 bp, Artificial Sequence
  Description of Artificial Sequence: Synthetic oligonucleotide
  Target: SOD1; (+) strand; PAM type: YTN; PAM sequence: TTT
tcacgtattaatccagtttt

SEQ ID NO: 15833 - DNA, 20 bp, Artificial Sequence
  Description of Artificial Sequence: Synthetic oligonucleotide
  Target: SOD1; (+) strand; PAM type: YTN; PAM sequence: TTT
cacgtattaatccagttttc

SEQ ID NO: 15834 - DNA, 20 bp, Artificial Sequence
  Description of Artificial Sequence: Synthetic oligonucleotide
  Target: SOD1; (+) strand; PAM type: YTN; PAM sequence: TTC
acgtattaatccagttttcc

SEQ ID NO: 15835 - DNA, 20 bp, Artificial Sequence
  Description of Artificial Sequence: Synthetic oligonucleotide
  Target: SOD1; (+) strand; PAM type: YTN; PAM sequence: TTA
atccagttttcctagcttct

SEQ ID NO: 15836 - DNA, 20 bp, Artificial Sequence
  Description of Artificial Sequence: Synthetic oligonucleotide
  Target: SOD1; (+) strand; PAM type: YTN; PAM sequence: TTT
tcctagcttctcttgaagaa

SEQ ID NO: 15837 - DNA, 20 bp, Artificial Sequence
  Description of Artificial Sequence: Synthetic oligonucleotide
  Target: SOD1; (+) strand; PAM type: YTN; PAM sequence: TTT
cctagcttctcttgaagaat

SEQ ID NO: 15838 - DNA, 20 bp, Artificial Sequence
  Description of Artificial Sequence: Synthetic oligonucleotide
  Target: SOD1; (+) strand; PAM type: YTN; PAM sequence: TTC
ctagcttctcttgaagaatt

SEQ ID NO: 15839 - DNA, 20 bp, Artificial Sequence
  Description of Artificial Sequence: Synthetic oligonucleotide
  Target: SOD1; (+) strand; PAM type: YTN; PAM sequence: CTA
gcttctcttgaagaattttt

SEQ ID NO: 15840 - DNA, 20 bp, Artificial Sequence
  Description of Artificial Sequence: Synthetic oligonucleotide
  Target: SOD1; (+) strand; PAM type: YTN; PAM sequence: CTT
ctcttgaagaatttttggag

SEQ ID NO: 15841 - DNA, 20 bp, Artificial Sequence
  Description of Artificial Sequence: Synthetic oligonucleotide
  Target: SOD1; (+) strand; PAM type: YTN; PAM sequence: TTC
tcttgaagaatttttggaga

SEQ ID NO: 15842 - DNA, 20 bp, Artificial Sequence
  Description of Artificial Sequence: Synthetic oligonucleotide
  Target: SOD1; (+) strand; PAM type: YTN; PAM sequence: CTC
ttgaagaatttttggagatc

SEQ ID NO: 15843 - DNA, 20 bp, Artificial Sequence
  Description of Artificial Sequence: Synthetic oligonucleotide
  Target: SOD1; (+) strand; PAM type: YTN; PAM sequence: CTT
gaagaatttttggagatctc

SEQ ID NO: 15844 - DNA, 20 bp, Artificial Sequence
  Description of Artificial Sequence: Synthetic oligonucleotide
  Target: SOD1; (+) strand; PAM type: YTN; PAM sequence: TTG
aagaatttttggagatctct

SEQ ID NO: 15845 - DNA, 20 bp, Artificial Sequence
  Description of Artificial Sequence: Synthetic oligonucleotide
  Target: SOD1; (+) strand; PAM type: YTN; PAM sequence: TTT
ttggagatctcttcatactg

SEQ ID NO: 15846 - DNA, 20 bp, Artificial Sequence
  Description of Artificial Sequence: Synthetic oligonucleotide
  Target: SOD1; (+) strand; PAM type: YTN; PAM sequence: TTT
tggagatctcttcatactga

SEQ ID NO: 15847 - DNA, 20 bp, Artificial Sequence
  Description of Artificial Sequence: Synthetic oligonucleotide
  Target: SOD1; (+) strand; PAM type: YTN; PAM sequence: TTT
ggagatctcttcatactgag

SEQ ID NO: 15848 - DNA, 20 bp, Artificial Sequence
  Description of Artificial Sequence: Synthetic oligonucleotide
  Target: SOD1; (+) strand; PAM type: YTN; PAM sequence: TTG
gagatctcttcatactgagc

SEQ ID NO: 15849 - DNA, 20 bp, Artificial Sequence
  Description of Artificial Sequence: Synthetic oligonucleotide
  Target: SOD1; (+) strand; PAM type: YTN; PAM sequence: CTC
ttcatactgagccttcatta

SEQ ID NO: 15850 - DNA, 20 bp, Artificial Sequence
  Description of Artificial Sequence: Synthetic oligonucleotide
  Target: SOD1; (+) strand; PAM type: YTN; PAM sequence: CTT
catactgagccttcattagc

SEQ ID NO: 15851 - DNA, 20 bp, Artificial Sequence
  Description of Artificial Sequence: Synthetic oligonucleotide
  Target: SOD1; (+) strand; PAM type: YTN; PAM sequence: TTC
atactgagccttcattagcc

SEQ ID NO: 15852 - DNA, 20 bp, Artificial Sequence
  Description of Artificial Sequence: Synthetic oligonucleotide
  Target: SOD1; (+) strand; PAM type: YTN; PAM sequence: CTG
agccttcattagcccaggac

SEQ ID NO: 15853 - DNA, 20 bp, Artificial Sequence
  Description of Artificial Sequence: Synthetic oligonucleotide
  Target: SOD1; (+) strand; PAM type: YTN; PAM sequence: CTT
cattagcccaggacagtact

SEQ ID NO: 15854 - DNA, 20 bp, Artificial Sequence
  Description of Artificial Sequence: Synthetic oligonucleotide
  Target: SOD1; (+) strand; PAM type: YTN; PAM sequence: TTC
attagcccaggacagtactg

SEQ ID NO: 15855 - DNA, 20 bp, Artificial Sequence
  Description of Artificial Sequence: Synthetic oligonucleotide
  Target: SOD1; (+) strand; PAM type: YTN; PAM sequence: TTA
gcccaggacagtactgctgt

SEQ ID NO: 15856 - DNA, 20 bp, Artificial Sequence
  Description of Artificial Sequence: Synthetic oligonucleotide
  Target: SOD1; (+) strand; PAM type: YTN; PAM sequence: CTG
ctgtagcagttcatatattt

SEQ ID NO: 15857 - DNA, 20 bp, Artificial Sequence
  Description of Artificial Sequence: Synthetic oligonucleotide
  Target: SOD1; (+) strand; PAM type: YTN; PAM sequence: CTG
tagcagttcatatatttttt

SEQ ID NO: 15858 - DNA, 20 bp, Artificial Sequence
  Description of Artificial Sequence: Synthetic oligonucleotide
  Target: SOD1; (+) strand; PAM type: YTN; PAM sequence: TTC
atatattttttcgcttccca

SEQ ID NO: 15859 - DNA, 20 bp, Artificial Sequence
  Description of Artificial Sequence: Synthetic oligonucleotide
  Target: SOD1; (+) strand; PAM type: YTN; PAM sequence: TTT
tttcgcttcccaggcctgtg

SEQ ID NO: 15860 - DNA, 20 bp, Artificial Sequence
  Description of Artificial Sequence: Synthetic oligonucleotide
  Target: SOD1; (+) strand; PAM type: YTN; PAM sequence: TTT
ttcgcttcccaggcctgtgt

SEQ ID NO: 15861 - DNA, 20 bp, Artificial Sequence
  Description of Artificial Sequence: Synthetic oligonucleotide
  Target: SOD1; (+) strand; PAM type: YTN; PAM sequence: TTT
tcgcttcccaggcctgtgtt

SEQ ID NO: 15862 - DNA, 20 bp, Artificial Sequence
  Description of Artificial Sequence: Synthetic oligonucleotide
  Target: SOD1; (+) strand; PAM type: YTN; PAM sequence: TTT
cgcttcccaggcctgtgtta

SEQ ID NO: 15863 - DNA, 20 bp, Artificial Sequence
  Description of Artificial Sequence: Synthetic oligonucleotide
  Target: SOD1; (+) strand; PAM type: YTN; PAM sequence: TTC
gcttcccaggcctgtgttat

SEQ ID NO: 15864 - DNA, 20 bp, Artificial Sequence
  Description of Artificial Sequence: Synthetic oligonucleotide
  Target: SOD1; (+) strand; PAM type: YTN; PAM sequence: CTT
cccaggcctgtgttattcac

SEQ ID NO: 15865 - DNA, 20 bp, Artificial Sequence
  Description of Artificial Sequence: Synthetic oligonucleotide
  Target: SOD1; (+) strand; PAM type: YTN; PAM sequence: TTC
ccaggcctgtgttattcact

SEQ ID NO: 15866 - DNA, 20 bp, Artificial Sequence
  Description of Artificial Sequence: Synthetic oligonucleotide
  Target: SOD1; (+) strand; PAM type: YTN; PAM sequence: CTG
tgttattcacttaagttcat

SEQ ID NO: 15867 - DNA, 20 bp, Artificial Sequence
  Description of Artificial Sequence: Synthetic oligonucleotide
  Target: SOD1; (+) strand; PAM type: YTN; PAM sequence: TTA
ttcacttaagttcatagcct

SEQ ID NO: 15868 - DNA, 20 bp, Artificial Sequence
  Description of Artificial Sequence: Synthetic oligonucleotide
  Target: SOD1; (+) strand; PAM type: YTN; PAM sequence: TTC
acttaagttcatagcctggt

SEQ ID NO: 15869 - DNA, 20 bp, Artificial Sequence
  Description of Artificial Sequence: Synthetic oligonucleotide
  Target: SOD1; (+) strand; PAM type: YTN; PAM sequence: CTT
aagttcatagcctggtccct

SEQ ID NO: 15870 - DNA, 20 bp, Artificial Sequence
  Description of Artificial Sequence: Synthetic oligonucleotide
  Target: SOD1; (+) strand; PAM type: YTN; PAM sequence: TTA
agttcatagcctggtccctg

SEQ ID NO: 15871 - DNA, 20 bp, Artificial Sequence
  Description of Artificial Sequence: Synthetic oligonucleotide
  Target: SOD1; (+) strand; PAM type: YTN; PAM sequence: TTC
atagcctggtccctgcaggg

SEQ ID NO: 15872 - DNA, 20 bp, Artificial Sequence
  Description of Artificial Sequence: Synthetic oligonucleotide
  Target: SOD1; (+) strand; PAM type: YTN; PAM sequence: CTG
gtccctgcagggttgtaccc

SEQ ID NO: 15873 - DNA, 20 bp, Artificial Sequence
  Description of Artificial Sequence: Synthetic oligonucleotide
  Target: SOD1; (+) strand; PAM type: YTN; PAM sequence: CTG
cagggttgtacccgagcaca

SEQ ID NO: 15874 - DNA, 20 bp, Artificial Sequence
  Description of Artificial Sequence: Synthetic oligonucleotide
  Target: SOD1; (+) strand; PAM type: YTN; PAM sequence: TTG
tacccgagcacagctactta

SEQ ID NO: 15875 - DNA, 20 bp, Artificial Sequence
  Description of Artificial Sequence: Synthetic oligonucleotide
  Target: SOD1; (+) strand; PAM type: YTN; PAM sequence: CTA
cttagatgtcctgaatgtat

SEQ ID NO: 15876 - DNA, 20 bp, Artificial Sequence
  Description of Artificial Sequence: Synthetic oligonucleotide
  Target: SOD1; (+) strand; PAM type: YTN; PAM sequence: CTT
agatgtcctgaatgtattac

SEQ ID NO: 15877 - DNA, 20 bp, Artificial Sequence
  Description of Artificial Sequence: Synthetic oligonucleotide
  Target: SOD1; (+) strand; PAM type: YTN; PAM sequence: TTA
gatgtcctgaatgtattacc

SEQ ID NO: 15878 - DNA, 20 bp, Artificial Sequence
  Description of Artificial Sequence: Synthetic oligonucleotide
  Target: SOD1; (+) strand; PAM type: YTN; PAM sequence: CTG
aatgtattaccggttaaatg

SEQ ID NO: 15879 - DNA, 20 bp, Artificial Sequence
  Description of Artificial Sequence: Synthetic oligonucleotide
  Target: SOD1; (+) strand; PAM type: YTN; PAM sequence: TTA
ccggttaaatggaggtttca

SEQ ID NO: 15880 - DNA, 20 bp, Artificial Sequence
  Description of Artificial Sequence: Synthetic oligonucleotide
  Target: SOD1; (+) strand; PAM type: YTN; PAM sequence: TTA
aatggaggtttcaaagaacc

SEQ ID NO: 15881 - DNA, 20 bp, Artificial Sequence
  Description of Artificial Sequence: Synthetic oligonucleotide
  Target: SOD1; (+) strand; PAM type: YTN; PAM sequence: TTT
caaagaacctgctgtttttg

SEQ ID NO: 15882 - DNA, 20 bp, Artificial Sequence
  Description of Artificial Sequence: Synthetic oligonucleotide
  Target: SOD1; (+) strand; PAM type: YTN; PAM sequence: TTC
aaagaacctgctgtttttgg

SEQ ID NO: 15883 - DNA, 20 bp, Artificial Sequence
  Description of Artificial Sequence: Synthetic oligonucleotide
  Target: SOD1; (+) strand; PAM type: YTN; PAM sequence: CTG
ctgtttttggccctgtgctc

SEQ ID NO: 15884 - DNA, 20 bp, Artificial Sequence
  Description of Artificial Sequence: Synthetic oligonucleotide
  Target: SOD1; (+) strand; PAM type: YTN; PAM sequence: CTG
tttttggccctgtgctcttg

SEQ ID NO: 15885 - DNA, 20 bp, Artificial Sequence
  Description of Artificial Sequence: Synthetic oligonucleotide
  Target: SOD1; (+) strand; PAM type: YTN; PAM sequence: TTT
ttggccctgtgctcttgata

SEQ ID NO: 15886 - DNA, 20 bp, Artificial Sequence
  Description of Artificial Sequence: Synthetic oligonucleotide
  Target: SOD1; (+) strand; PAM type: YTN; PAM sequence: TTT
tggccctgtgctcttgataa

SEQ ID NO: 15887 - DNA, 20 bp, Artificial Sequence
  Description of Artificial Sequence: Synthetic oligonucleotide
  Target: SOD1; (+) strand; PAM type: YTN; PAM sequence: TTT
ggccctgtgctcttgataac

SEQ ID NO: 15888 - DNA, 20 bp, Artificial Sequence
  Description of Artificial Sequence: Synthetic oligonucleotide
  Target: SOD1; (+) strand; PAM type: YTN; PAM sequence: TTG
gccctgtgctcttgataaca

SEQ ID NO: 15889 - DNA, 20 bp, Artificial Sequence
  Description of Artificial Sequence: Synthetic oligonucleotide
  Target: SOD1; (+) strand; PAM type: YTN; PAM sequence: CTG
tgctcttgataacagagtgt

SEQ ID NO: 15890 - DNA, 20 bp, Artificial Sequence
  Description of Artificial Sequence: Synthetic oligonucleotide
  Target: SOD1; (+) strand; PAM type: YTN; PAM sequence: CTC
ttgataacagagtgtttgag

SEQ ID NO: 15891 - DNA, 20 bp, Artificial Sequence
  Description of Artificial Sequence: Synthetic oligonucleotide
  Target: SOD1; (+) strand; PAM type: YTN; PAM sequence: CTT
gataacagagtgtttgaggg

SEQ ID NO: 15892 - DNA, 20 bp, Artificial Sequence
  Description of Artificial Sequence: Synthetic oligonucleotide
  Target: SOD1; (+) strand; PAM type: YTN; PAM sequence: TTG
ataacagagtgtttgaggga

SEQ ID NO: 15893 - DNA, 20 bp, Artificial Sequence
  Description of Artificial Sequence: Synthetic oligonucleotide
  Target: SOD1; (+) strand; PAM type: YTN; PAM sequence: TTT
gagggacaactttcacattt

SEQ ID NO: 15894 - DNA, 20 bp, Artificial Sequence
  Description of Artificial Sequence: Synthetic oligonucleotide
  Target: SOD1; (+) strand; PAM type: YTN; PAM sequence: TTG
agggacaactttcacatttg

SEQ ID NO: 15895 - DNA, 20 bp, Artificial Sequence
  Description of Artificial Sequence: Synthetic oligonucleotide
  Target: SOD1; (+) strand; PAM type: YTN; PAM sequence: CTT
tcacatttgagtttttccaa

SEQ ID NO: 15896 - DNA, 20 bp, Artificial Sequence
  Description of Artificial Sequence: Synthetic oligonucleotide
  Target: SOD1; (+) strand; PAM type: YTN; PAM sequence: TTT
cacatttgagtttttccaaa

SEQ ID NO: 15897 - DNA, 20 bp, Artificial Sequence
  Description of Artificial Sequence: Synthetic oligonucleotide
  Target: SOD1; (+) strand; PAM type: YTN; PAM sequence: TTC
acatttgagtttttccaaaa

SEQ ID NO: 15898 - DNA, 20 bp, Artificial Sequence
  Description of Artificial Sequence: Synthetic oligonucleotide
  Target: SOD1; (+) strand; PAM type: YTN; PAM sequence: TTT
gagtttttccaaaattaaag

SEQ ID NO: 15899 - DNA, 20 bp, Artificial Sequence
  Description of Artificial Sequence: Synthetic oligonucleotide
  Target: SOD1; (+) strand; PAM type: YTN; PAM sequence: TTG
agtttttccaaaattaaagg

SEQ ID NO: 15900 - DNA, 20 bp, Artificial Sequence
  Description of Artificial Sequence: Synthetic oligonucleotide
  Target: SOD1; (+) strand; PAM type: YTN; PAM sequence: TTT
ttccaaaattaaaggttgta

SEQ ID NO: 15901 - DNA, 20 bp, Artificial Sequence
  Description of Artificial Sequence: Synthetic oligonucleotide
  Target: SOD1; (+) strand; PAM type: YTN; PAM sequence: TTT
tccaaaattaaaggttgtag

SEQ ID NO: 15902 - DNA, 20 bp, Artificial Sequence
  Description of Artificial Sequence: Synthetic oligonucleotide
  Target: SOD1; (+) strand; PAM type: YTN; PAM sequence: TTT
ccaaaattaaaggttgtaga

SEQ ID NO: 15903 - DNA, 20 bp, Artificial Sequence
  Description of Artificial Sequence: Synthetic oligonucleotide
  Target: SOD1; (+) strand; PAM type: YTN; PAM sequence: TTC
caaaattaaaggttgtagaa

SEQ ID NO: 15904 - DNA, 20 bp, Artificial Sequence
  Description of Artificial Sequence: Synthetic oligonucleotide
  Target: SOD1; (+) strand; PAM type: YTN; PAM sequence: TTA
aaggttgtagaagagtcaca

SEQ ID NO: 15905 - DNA, 20 bp, Artificial Sequence
  Description of Artificial Sequence: Synthetic oligonucleotide
  Target: SOD1; (+) strand; PAM type: YTN; PAM sequence: TTG
tagaagagtcacagtatcta

SEQ ID NO: 15906 - DNA, 20 bp, Artificial Sequence
  Description of Artificial Sequence: Synthetic oligonucleotide
  Target: SOD1; (+) strand; PAM type: YTN; PAM sequence: CTA
ttgtcaaaaagaaaagaatt

SEQ ID NO: 15907 - DNA, 20 bp, Artificial Sequence
  Description of Artificial Sequence: Synthetic oligonucleotide
  Target: SOD1; (+) strand; PAM type: YTN; PAM sequence: TTG
tcaaaaagaaaagaatttaa

SEQ ID NO: 15908 - DNA, 20 bp, Artificial Sequence
  Description of Artificial Sequence: Synthetic oligonucleotide
  Target: SOD1; (+) strand; PAM type: YTN; PAM sequence: TTT
aaaaaggcagcaattgccag

SEQ ID NO: 15909 - DNA, 20 bp, Artificial Sequence
  Description of Artificial Sequence: Synthetic oligonucleotide
  Target: SOD1; (+) strand; PAM type: YTN; PAM sequence: TTA
aaaaggcagcaattgccagg

SEQ ID NO: 15910 - DNA, 20 bp, Artificial Sequence
  Description of Artificial Sequence: Synthetic oligonucleotide
  Target: SOD1; (+) strand; PAM type: YTN; PAM sequence: TTG
ccaggatacttcatttgagc

SEQ ID NO: 15911 - DNA, 20 bp, Artificial Sequence
  Description of Artificial Sequence: Synthetic oligonucleotide
  Target: SOD1; (+) strand; PAM type: YTN; PAM sequence: CTT
catttgagcaatgatatttt

SEQ ID NO: 15912 - DNA, 20 bp, Artificial Sequence
  Description of Artificial Sequence: Synthetic oligonucleotide
  Target: SOD1; (+) strand; PAM type: YTN; PAM sequence: TTC
atttgagcaatgatattttc

SEQ ID NO: 15913 - DNA, 20 bp, Artificial Sequence
  Description of Artificial Sequence: Synthetic oligonucleotide
  Target: SOD1; (+) strand; PAM type: YTN; PAM sequence: TTT
gagcaatgatattttccagt

SEQ ID NO: 15914 - DNA, 20 bp, Artificial Sequence
  Description of Artificial Sequence: Synthetic oligonucleotide
  Target: SOD1; (+) strand; PAM type: YTN; PAM sequence: TTG
agcaatgatattttccagtg

SEQ ID NO: 15915 - DNA, 20 bp, Artificial Sequence
  Description of Artificial Sequence: Synthetic oligonucleotide
  Target: SOD1; (+) strand; PAM type: YTN; PAM sequence: TTT
tccagtggaaagtcacatct

SEQ ID NO: 15916 - DNA, 20 bp, Artificial Sequence
  Description of Artificial Sequence: Synthetic oligonucleotide
  Target: SOD1; (+) strand; PAM type: YTN; PAM sequence: TTT
ccagtggaaagtcacatctt

SEQ ID NO: 15917 - DNA, 20 bp, Artificial Sequence
  Description of Artificial Sequence: Synthetic oligonucleotide
  Target: SOD1; (+) strand; PAM type: YTN; PAM sequence: TTC
cagtggaaagtcacatctta

SEQ ID NO: 15918 - DNA, 20 bp, Artificial Sequence
  Description of Artificial Sequence: Synthetic oligonucleotide
  Target: SOD1; (+) strand; PAM type: YTN; PAM sequence: CTT
aagggttaatgccccttaac

SEQ ID NO: 15919 - DNA, 20 bp, Artificial Sequence
  Description of Artificial Sequence: Synthetic oligonucleotide
  Target: SOD1; (+) strand; PAM type: YTN; PAM sequence: TTA
agggttaatgccccttaact

SEQ ID NO: 15920 - DNA, 20 bp, Artificial Sequence
  Description of Artificial Sequence: Synthetic oligonucleotide
  Target: SOD1; (+) strand; PAM type: YTN; PAM sequence: TTA
atgccccttaactgttggcc

SEQ ID NO: 15921 - DNA, 20 bp, Artificial Sequence
  Description of Artificial Sequence: Synthetic oligonucleotide
  Target: SOD1; (+) strand; PAM type: YTN; PAM sequence: CTT
aactgttggccgtatttgaa

SEQ ID NO: 15922 - DNA, 20 bp, Artificial Sequence
  Description of Artificial Sequence: Synthetic oligonucleotide
  Target: SOD1; (+) strand; PAM type: YTN; PAM sequence: TTA
actgttggccgtatttgaaa

SEQ ID NO: 15923 - DNA, 20 bp, Artificial Sequence
  Description of Artificial Sequence: Synthetic oligonucleotide
  Target: SOD1; (+) strand; PAM type: YTN; PAM sequence: CTG
ttggccgtatttgaaaacaa

SEQ ID NO: 15924 - DNA, 20 bp, Artificial Sequence
  Description of Artificial Sequence: Synthetic oligonucleotide
  Target: SOD1; (+) strand; PAM type: YTN; PAM sequence: TTG
gccgtatttgaaaacaaacc

SEQ ID NO: 15925 - DNA, 20 bp, Artificial Sequence
  Description of Artificial Sequence: Synthetic oligonucleotide
  Target: SOD1; (+) strand; PAM type: YTN; PAM sequence: TTT
gaaaacaaaccaagctaaaa

SEQ ID NO: 15926 - DNA, 20 bp, Artificial Sequence
  Description of Artificial Sequence: Synthetic oligonucleotide
  Target: SOD1; (+) strand; PAM type: YTN; PAM sequence: TTG
aaaacaaaccaagctaaaaa

SEQ ID NO: 15927 - DNA, 20 bp, Artificial Sequence
  Description of Artificial Sequence: Synthetic oligonucleotide
  Target: SOD1; (+) strand; PAM type: YTN; PAM sequence: CTA
aaaacaagagacactgacat

SEQ ID NO: 15928 - DNA, 20 bp, Artificial Sequence
  Description of Artificial Sequence: Synthetic oligonucleotide
  Target: SOD1; (+) strand; PAM type: YTN; PAM sequence: CTG
acatgttgtatgacggtgtg

SEQ ID NO: 15929 - DNA, 20 bp, Artificial Sequence
  Description of Artificial Sequence: Synthetic oligonucleotide
  Target: SOD1; (+) strand; PAM type: YTN; PAM sequence: TTG
tatgacggtgtggtgtggat

SEQ ID NO: 15930 - DNA, 20 bp, Artificial Sequence
  Description of Artificial Sequence: Synthetic oligonucleotide
  Target: SOD1; (+) strand; PAM type: YTN; PAM sequence: TTG
tgtttattttagtcctgaga

SEQ ID NO: 15931 - DNA, 20 bp, Artificial Sequence
  Description of Artificial Sequence: Synthetic oligonucleotide
  Target: SOD1; (+) strand; PAM type: YTN; PAM sequence: TTT
attttagtcctgagatctag

SEQ ID NO: 15932 - DNA, 20 bp, Artificial Sequence
  Description of Artificial Sequence: Synthetic oligonucleotide
  Target: SOD1; (+) strand; PAM type: YTN; PAM sequence: TTA
ttttagtcctgagatctagt

SEQ ID NO: 15933 - DNA, 20 bp, Artificial Sequence
  Description of Artificial Sequence: Synthetic oligonucleotide
  Target: SOD1; (+) strand; PAM type: YTN; PAM sequence: TTT
tagtcctgagatctagttgt

SEQ ID NO: 15934 - DNA, 20 bp, Artificial Sequence
  Description of Artificial Sequence: Synthetic oligonucleotide
  Target: SOD1; (+) strand; PAM type: YTN; PAM sequence: TTT
agtcctgagatctagttgta

SEQ ID NO: 15935 - DNA, 20 bp, Artificial Sequence
  Description of Artificial Sequence: Synthetic oligonucleotide
  Target: SOD1; (+) strand; PAM type: YTN; PAM sequence: TTA
gtcctgagatctagttgtaa

SEQ ID NO: 15936 - DNA, 20 bp, Artificial Sequence
  Description of Artificial Sequence: Synthetic oligonucleotide
  Target: SOD1; (+) strand; PAM type: YTN; PAM sequence: CTG
agatctagttgtaacttcct

SEQ ID NO: 15937 - DNA, 20 bp, Artificial Sequence
  Description of Artificial Sequence: Synthetic oligonucleotide
  Target: SOD1; (+) strand; PAM type: YTN; PAM sequence: CTA
gttgtaacttccttgatttc

SEQ ID NO: 15938 - DNA, 20 bp, Artificial Sequence
  Description of Artificial Sequence: Synthetic oligonucleotide
  Target: SOD1; (+) strand; PAM type: YTN; PAM sequence: TTG
taacttccttgatttctgta

SEQ ID NO: 15939 - DNA, 20 bp, Artificial Sequence
  Description of Artificial Sequence: Synthetic oligonucleotide
  Target: SOD1; (+) strand; PAM type: YTN; PAM sequence: CTT
ccttgatttctgtatgtagc

SEQ ID NO: 15940 - DNA, 20 bp, Artificial Sequence
  Description of Artificial Sequence: Synthetic oligonucleotide
  Target: SOD1; (+) strand; PAM type: YTN; PAM sequence: TTC
cttgatttctgtatgtagcc

SEQ ID NO: 15941 - DNA, 20 bp, Artificial Sequence
  Description of Artificial Sequence: Synthetic oligonucleotide
  Target: SOD1; (+) strand; PAM type: YTN; PAM sequence: CTT
gatttctgtatgtagccacg

SEQ ID NO: 15942 - DNA, 20 bp, Artificial Sequence
  Description of Artificial Sequence: Synthetic oligonucleotide
  Target: SOD1; (+) strand; PAM type: YTN; PAM sequence: TTG
atttctgtatgtagccacgg

SEQ ID NO: 15943 - DNA, 20 bp, Artificial Sequence
  Description of Artificial Sequence: Synthetic oligonucleotide
  Target: SOD1; (+) strand; PAM type: YTN; PAM sequence: TTT
ctgtatgtagccacggagca

SEQ ID NO: 15944 - DNA, 20 bp, Artificial Sequence
  Description of Artificial Sequence: Synthetic oligonucleotide
  Target: SOD1; (+) strand; PAM type: YTN; PAM sequence: TTC
tgtatgtagccacggagcac

SEQ ID NO: 15945 - DNA, 20 bp, Artificial Sequence
  Description of Artificial Sequence: Synthetic oligonucleotide
  Target: SOD1; (+) strand; PAM type: YTN; PAM sequence: CTG
tatgtagccacggagcacca

SEQ ID NO: 15946 - DNA, 20 bp, Artificial Sequence
  Description of Artificial Sequence: Synthetic oligonucleotide
  Target: SOD1; (+) strand; PAM type: YTN; PAM sequence: TTA
cctgtcaccattacctgaat

SEQ ID NO: 15947 - DNA, 20 bp, Artificial Sequence
  Description of Artificial Sequence: Synthetic oligonucleotide
  Target: SOD1; (+) strand; PAM type: YTN; PAM sequence: CTG
tcaccattacctgaatggct

SEQ ID NO: 15948 - DNA, 20 bp, Artificial Sequence
  Description of Artificial Sequence: Synthetic oligonucleotide
  Target: SOD1; (+) strand; PAM type: YTN; PAM sequence: TTA
cctgaatggctatactgctt

SEQ ID NO: 15949 - DNA, 20 bp, Artificial Sequence
  Description of Artificial Sequence: Synthetic oligonucleotide
  Target: SOD1; (+) strand; PAM type: YTN; PAM sequence: CTG
aatggctatactgcttgctt

SEQ ID NO: 15950 - DNA, 20 bp, Artificial Sequence
  Description of Artificial Sequence: Synthetic oligonucleotide
  Target: SOD1; (+) strand; PAM type: YTN; PAM sequence: CTA
tactgcttgctttcattttg

SEQ ID NO: 15951 - DNA, 20 bp, Artificial Sequence
  Description of Artificial Sequence: Synthetic oligonucleotide
  Target: SOD1; (+) strand; PAM type: YTN; PAM sequence: CTG
cttgctttcattttggtaga

SEQ ID NO: 15952 - DNA, 20 bp, Artificial Sequence
  Description of Artificial Sequence: Synthetic oligonucleotide
  Target: SOD1; (+) strand; PAM type: YTN; PAM sequence: CTT
gctttcattttggtagagtg

SEQ ID NO: 15953 - DNA, 20 bp, Artificial Sequence
  Description of Artificial Sequence: Synthetic oligonucleotide
  Target: SOD1; (+) strand; PAM type: YTN; PAM sequence: TTG
ctttcattttggtagagtgg

SEQ ID NO: 15954 - DNA, 20 bp, Artificial Sequence
  Description of Artificial Sequence: Synthetic oligonucleotide
  Target: SOD1; (+) strand; PAM type: YTN; PAM sequence: CTT
tcattttggtagagtggaaa

SEQ ID NO: 15955 - DNA, 20 bp, Artificial Sequence
  Description of Artificial Sequence: Synthetic oligonucleotide
  Target: SOD1; (+) strand; PAM type: YTN; PAM sequence: TTT
cattttggtagagtggaaag

SEQ ID NO: 15956 - DNA, 20 bp, Artificial Sequence
  Description of Artificial Sequence: Synthetic oligonucleotide
  Target: SOD1; (+) strand; PAM type: YTN; PAM sequence: TTC
attttggtagagtggaaagg

SEQ ID NO: 15957 - DNA, 20 bp, Artificial Sequence
  Description of Artificial Sequence: Synthetic oligonucleotide
  Target: SOD1; (+) strand; PAM type: YTN; PAM sequence: TTT
tggtagagtggaaaggttac

SEQ ID NO: 15958 - DNA, 20 bp, Artificial Sequence
  Description of Artificial Sequence: Synthetic oligonucleotide
  Target: SOD1; (+) strand; PAM type: YTN; PAM sequence: TTT
ggtagagtggaaaggttacc

SEQ ID NO: 15959 - DNA, 20 bp, Artificial Sequence
  Description of Artificial Sequence: Synthetic oligonucleotide
  Target: SOD1; (+) strand; PAM type: YTN; PAM sequence: TTG
gtagagtggaaaggttacct

SEQ ID NO: 15960 - DNA, 20 bp, Artificial Sequence
  Description of Artificial Sequence: Synthetic oligonucleotide
  Target: SOD1; (+) strand; PAM type: YTN; PAM sequence: TTA
cctaggtttcagtgcttgaa

SEQ ID NO: 15961 - DNA, 20 bp, Artificial Sequence
  Description of Artificial Sequence: Synthetic oligonucleotide
  Target: SOD1; (+) strand; PAM type: YTN; PAM sequence: CTA
ggtttcagtgcttgaaaaga

SEQ ID NO: 15962 - DNA, 20 bp, Artificial Sequence
  Description of Artificial Sequence: Synthetic oligonucleotide
  Target: SOD1; (+) strand; PAM type: YTN; PAM sequence: TTT
cagtgcttgaaaagatttca

SEQ ID NO: 15963 - DNA, 20 bp, Artificial Sequence
  Description of Artificial Sequence: Synthetic oligonucleotide
  Target: SOD1; (+) strand; PAM type: YTN; PAM sequence: TTC
agtgcttgaaaagatttcag

SEQ ID NO: 15964 - DNA, 20 bp, Artificial Sequence
  Description of Artificial Sequence: Synthetic oligonucleotide
  Target: SOD1; (+) strand; PAM type: YTN; PAM sequence: CTT
gaaaagatttcagaaagcag

SEQ ID NO: 15965 - DNA, 20 bp, Artificial Sequence
  Description of Artificial Sequence: Synthetic oligonucleotide
  Target: SOD1; (+) strand; PAM type: YTN; PAM sequence: TTG
aaaagatttcagaaagcagt

SEQ ID NO: 15966 - DNA, 20 bp, Artificial Sequence
  Description of Artificial Sequence: Synthetic oligonucleotide
  Target: SOD1; (+) strand; PAM type: YTN; PAM sequence: TTT
cagaaagcagtagtacgtct

SEQ ID NO: 15967 - DNA, 20 bp, Artificial Sequence
  Description of Artificial Sequence: Synthetic oligonucleotide
  Target: SOD1; (+) strand; PAM type: YTN; PAM sequence: TTC
agaaagcagtagtacgtctg

SEQ ID NO: 15968 - DNA, 20 bp, Artificial Sequence
  Description of Artificial Sequence: Synthetic oligonucleotide
  Target: SOD1; (+) strand; PAM type: YTN; PAM sequence: CTG
gttagactagaatcagtcct

SEQ ID NO: 15969 - DNA, 20 bp, Artificial Sequence
  Description of Artificial Sequence: Synthetic oligonucleotide
  Target: SOD1; (+) strand; PAM type: YTN; PAM sequence: TTA
gactagaatcagtcctctcc

SEQ ID NO: 15970 - DNA, 20 bp, Artificial Sequence
  Description of Artificial Sequence: Synthetic oligonucleotide
  Target: SOD1; (+) strand; PAM type: YTN; PAM sequence: CTA
gaatcagtcctctcctgggg

SEQ ID NO: 15971 - DNA, 20 bp, Artificial Sequence
  Description of Artificial Sequence: Synthetic oligonucleotide
  Target: SOD1; (+) strand; PAM type: YTN; PAM sequence: CTC
tcctgggggcagtggaatat

SEQ ID NO: 15972 - DNA, 20 bp, Artificial Sequence
  Description of Artificial Sequence: Synthetic oligonucleotide
  Target: SOD1; (+) strand; PAM type: YTN; PAM sequence: CTC
ctgggggcagtggaatataa

SEQ ID NO: 15973 - DNA, 20 bp, Artificial Sequence
  Description of Artificial Sequence: Synthetic oligonucleotide
  Target: SOD1; (+) strand; PAM type: YTN; PAM sequence: CTG
ggggcagtggaatataatat

SEQ ID NO: 15974 - DNA, 20 bp, Artificial Sequence
  Description of Artificial Sequence: Synthetic oligonucleotide
  Target: SOD1; (+) strand; PAM type: YTN; PAM sequence: TTT
tctgactgctaattaaaaat

SEQ ID NO: 15975 - DNA, 20 bp, Artificial Sequence
  Description of Artificial Sequence: Synthetic oligonucleotide
  Target: SOD1; (+) strand; PAM type: YTN; PAM sequence: TTT
ctgactgctaattaaaaata

SEQ ID NO: 15976 - DNA, 20 bp, Artificial Sequence
  Description of Artificial Sequence: Synthetic oligonucleotide
  Target: SOD1; (+) strand; PAM type: YTN; PAM sequence: TTC
tgactgctaattaaaaatac

SEQ ID NO: 15977 - DNA, 20 bp, Artificial Sequence
  Description of Artificial Sequence: Synthetic oligonucleotide
  Target: SOD1; (+) strand; PAM type: YTN; PAM sequence: CTG
actgctaattaaaaatacct

SEQ ID NO: 15978 - DNA, 20 bp, Artificial Sequence
  Description of Artificial Sequence: Synthetic oligonucleotide
  Target: SOD1; (+) strand; PAM type: YTN; PAM sequence: CTG
ctaattaaaaatacctgtga

SEQ ID NO: 15979 - DNA, 20 bp, Artificial Sequence
  Description of Artificial Sequence: Synthetic oligonucleotide
  Target: SOD1; (+) strand; PAM type: YTN; PAM sequence: CTA
attaaaaatacctgtgatag

SEQ ID NO: 15980 - DNA, 20 bp, Artificial Sequence
  Description of Artificial Sequence: Synthetic oligonucleotide
  Target: SOD1; (+) strand; PAM type: YTN; PAM sequence: TTA
aaaatacctgtgatagccgg

SEQ ID NO: 15981 - DNA, 20 bp, Artificial Sequence
  Description of Artificial Sequence: Synthetic oligonucleotide
  Target: SOD1; (+) strand; PAM type: YTN; PAM sequence: CTG
tgatagccgggcgtggtggc

SEQ ID NO: 15982 - DNA, 20 bp, Artificial Sequence
  Description of Artificial Sequence: Synthetic oligonucleotide
  Target: SOD1; (+) strand; PAM type: YTN; PAM sequence: CTT
acgcctgtaatcccagcact

SEQ ID NO: 15983 - DNA, 20 bp, Artificial Sequence
  Description of Artificial Sequence: Synthetic oligonucleotide
  Target: SOD1; (+) strand; PAM type: YTN; PAM sequence: TTA
cgcctgtaatcccagcactt

SEQ ID NO: 15984 - DNA, 20 bp, Artificial Sequence
  Description of Artificial Sequence: Synthetic oligonucleotide
  Target: SOD1; (+) strand; PAM type: YTN; PAM sequence: CTG
taatcccagcactttgggag

SEQ ID NO: 15985 - DNA, 20 bp, Artificial Sequence
  Description of Artificial Sequence: Synthetic oligonucleotide
  Target: SOD1; (+) strand; PAM type: YTN; PAM sequence: CTT
tgggaggccgagacgggtgg

SEQ ID NO: 15986 - DNA, 20 bp, Artificial Sequence
  Description of Artificial Sequence: Synthetic oligonucleotide
  Target: SOD1; (+) strand; PAM type: YTN; PAM sequence: TTT
gggaggccgagacgggtgga

SEQ ID NO: 15987 - DNA, 20 bp, Artificial Sequence
  Description of Artificial Sequence: Synthetic oligonucleotide
  Target: SOD1; (+) strand; PAM type: YTN; PAM sequence: TTG
ggaggccgagacgggtggat

SEQ ID NO: 15988 - DNA, 20 bp, Artificial Sequence
  Description of Artificial Sequence: Synthetic oligonucleotide
  Target: SOD1; (+) strand; PAM type: YTN; PAM sequence: CTG
gctaacacggtgaaaccccg

SEQ ID NO: 15989 - DNA, 20 bp, Artificial Sequence
  Description of Artificial Sequence: Synthetic oligonucleotide
  Target: SOD1; (+) strand; PAM type: YTN; PAM sequence: CTA
acacggtgaaaccccgtctc

SEQ ID NO: 15990 - DNA, 20 bp, Artificial Sequence
  Description of Artificial Sequence: Synthetic oligonucleotide
  Target: SOD1; (+) strand; PAM type: YTN; PAM sequence: CTC
tactaaaaatgcaaaaaaat

SEQ ID NO: 15991 - DNA, 20 bp, Artificial Sequence
  Description of Artificial Sequence: Synthetic oligonucleotide
  Target: SOD1; (+) strand; PAM type: YTN; PAM sequence: CTA
ctaaaaatgcaaaaaaatta

SEQ ID NO: 15992 - DNA, 20 bp, Artificial Sequence
  Description of Artificial Sequence: Synthetic oligonucleotide
  Target: SOD1; (+) strand; PAM type: YTN; PAM sequence: CTA
aaaatgcaaaaaaattagcc

SEQ ID NO: 15993 - DNA, 20 bp, Artificial Sequence
  Description of Artificial Sequence: Synthetic oligonucleotide
  Target: SOD1; (+) strand; PAM type: YTN; PAM sequence: TTA
gccgggtgtggtggtgggcg

SEQ ID NO: 15994 - DNA, 20 bp, Artificial Sequence
  Description of Artificial Sequence: Synthetic oligonucleotide
  Target: SOD1; (+) strand; PAM type: YTN; PAM sequence: CTG
tagtcccagctactcaggag

SEQ ID NO: 15995 - DNA, 20 bp, Artificial Sequence
  Description of Artificial Sequence: Synthetic oligonucleotide
  Target: SOD1; (+) strand; PAM type: YTN; PAM sequence: CTA
ctcaggaggctgaggcagga

SEQ ID NO: 15996 - DNA, 20 bp, Artificial Sequence
  Description of Artificial Sequence: Synthetic oligonucleotide
  Target: SOD1; (+) strand; PAM type: YTN; PAM sequence: CTC
aggaggctgaggcaggagaa

SEQ ID NO: 15997 - DNA, 20 bp, Artificial Sequence
  Description of Artificial Sequence: Synthetic oligonucleotide
  Target: SOD1; (+) strand; PAM type: YTN; PAM sequence: CTG
aggcaggagaatggcatgaa

SEQ ID NO: 15998 - DNA, 20 bp, Artificial Sequence
  Description of Artificial Sequence: Synthetic oligonucleotide
  Target: SOD1; (+) strand; PAM type: YTN; PAM sequence: CTG
ggaggcggagcttgcagtga

SEQ ID NO: 15999 - DNA, 20 bp, Artificial Sequence
  Description of Artificial Sequence: Synthetic oligonucleotide
  Target: SOD1; (+) strand; PAM type: YTN; PAM sequence: CTT
gcagtgagccgagatcatgt

SEQ ID NO: 16000 - DNA, 20 bp, Artificial Sequence
  Description of Artificial Sequence: Synthetic oligonucleotide
  Target: SOD1; (+) strand; PAM type: YTN; PAM sequence: TTG
cagtgagccgagatcatgtc

SEQ ID NO: 16001 - DNA, 20 bp, Artificial Sequence
  Description of Artificial Sequence: Synthetic oligonucleotide
  Target: SOD1; (+) strand; PAM type: YTN; PAM sequence: CTG
cactccagcctgggcgacag

SEQ ID NO: 16002 - DNA, 20 bp, Artificial Sequence
  Description of Artificial Sequence: Synthetic oligonucleotide
  Target: SOD1; (+) strand; PAM type: YTN; PAM sequence: CTC
cagcctgggcgacagagcga

SEQ ID NO: 16003 - DNA, 20 bp, Artificial Sequence
  Description of Artificial Sequence: Synthetic oligonucleotide
  Target: SOD1; (+) strand; PAM type: YTN; PAM sequence: CTG
ggcgacagagcgagactcgt

SEQ ID NO: 16004 - DNA, 20 bp, Artificial Sequence
  Description of Artificial Sequence: Synthetic oligonucleotide
  Target: SOD1; (+) strand; PAM type: YTN; PAM sequence: CTC
gtctcaaaaaaaaaaagaaa

SEQ ID NO: 16005 - DNA, 20 bp, Artificial Sequence
  Description of Artificial Sequence: Synthetic oligonucleotide
  Target: SOD1; (+) strand; PAM type: YTN; PAM sequence: CTC
aaaaaaaaaaagaaaaaaac

SEQ ID NO: 16006 - DNA, 20 bp, Artificial Sequence
  Description of Artificial Sequence: Synthetic oligonucleotide
  Target: SOD1; (+) strand; PAM type: YTN; PAM sequence: CTT
atgatggacacttaaaaaca

SEQ ID NO: 16007 - DNA, 20 bp, Artificial Sequence
  Description of Artificial Sequence: Synthetic oligonucleotide
  Target: SOD1; (+) strand; PAM type: YTN; PAM sequence: TTA
tgatggacacttaaaaacac

SEQ ID NO: 16008 - DNA, 20 bp, Artificial Sequence
  Description of Artificial Sequence: Synthetic oligonucleotide
  Target: SOD1; (+) strand; PAM type: YTN; PAM sequence: CTT
aaaaacactcactgagtggg

SEQ ID NO: 16009 - DNA, 20 bp, Artificial Sequence
  Description of Artificial Sequence: Synthetic oligonucleotide
  Target: SOD1; (+) strand; PAM type: YTN; PAM sequence: TTA
aaaacactcactgagtgggg

SEQ ID NO: 16010 - DNA, 20 bp, Artificial Sequence
  Description of Artificial Sequence: Synthetic oligonucleotide
  Target: SOD1; (+) strand; PAM type: YTN; PAM sequence: CTC
actgagtggggagtggagag

SEQ ID NO: 16011 - DNA, 20 bp, Artificial Sequence
  Description of Artificial Sequence: Synthetic oligonucleotide
  Target: SOD1; (+) strand; PAM type: YTN; PAM sequence: CTG
agtggggagtggagagcagg

SEQ ID NO: 16012 - DNA, 20 bp, Artificial Sequence
  Description of Artificial Sequence: Synthetic oligonucleotide
  Target: SOD1; (+) strand; PAM type: YTN; PAM sequence: CTG
ttggacatttccagggcgac

SEQ ID NO: 16013 - DNA, 20 bp, Artificial Sequence
  Description of Artificial Sequence: Synthetic oligonucleotide
  Target: SOD1; (+) strand; PAM type: YTN; PAM sequence: TTG
gacatttccagggcgacttt

SEQ ID NO: 16014 - DNA, 20 bp, Artificial Sequence
  Description of Artificial Sequence: Synthetic oligonucleotide
  Target: SOD1; (+) strand; PAM type: YTN; PAM sequence: TTT
ccagggcgactttttctttt

SEQ ID NO: 16015 - DNA, 20 bp, Artificial Sequence
  Description of Artificial Sequence: Synthetic oligonucleotide
  Target: SOD1; (+) strand; PAM type: YTN; PAM sequence: TTC
cagggcgactttttcttttt

SEQ ID NO: 16016 - DNA, 20 bp, Artificial Sequence
  Description of Artificial Sequence: Synthetic oligonucleotide
  Target: SOD1; (+) strand; PAM type: YTN; PAM sequence: CTT
tttctttttttttttttaaa

SEQ ID NO: 16017 - DNA, 20 bp, Artificial Sequence
  Description of Artificial Sequence: Synthetic oligonucleotide
  Target: SOD1; (+) strand; PAM type: YTN; PAM sequence: TTT
ttctttttttttttttaaag

SEQ ID NO: 16018 - DNA, 20 bp, Artificial Sequence
  Description of Artificial Sequence: Synthetic oligonucleotide
  Target: SOD1; (+) strand; PAM type: YTN; PAM sequence: TTT
tctttttttttttttaaagt

SEQ ID NO: 16019 - DNA, 20 bp, Artificial Sequence
  Description of Artificial Sequence: Synthetic oligonucleotide
  Target: SOD1; (+) strand; PAM type: YTN; PAM sequence: TTT
ctttttttttttttaaagtc

SEQ ID NO: 16020 - DNA, 20 bp, Artificial Sequence
  Description of Artificial Sequence: Synthetic oligonucleotide
  Target: SOD1; (+) strand; PAM type: YTN; PAM sequence: TTC
tttttttttttttaaagtca

SEQ ID NO: 16021 - DNA, 20 bp, Artificial Sequence
  Description of Artificial Sequence: Synthetic oligonucleotide
  Target: SOD1; (+) strand; PAM type: YTN; PAM sequence: CTT
tttttttttttaaagtcaag

SEQ ID NO: 16022 - DNA, 20 bp, Artificial Sequence
  Description of Artificial Sequence: Synthetic oligonucleotide
  Target: SOD1; (+) strand; PAM type: YTN; PAM sequence: TTT
ttttttttttaaagtcaagt

SEQ ID NO: 16023 - DNA, 20 bp, Artificial Sequence
  Description of Artificial Sequence: Synthetic oligonucleotide
  Target: SOD1; (+) strand; PAM type: YTN; PAM sequence: TTT
tttttttttaaagtcaagtg

SEQ ID NO: 16024 - DNA, 20 bp, Artificial Sequence
  Description of Artificial Sequence: Synthetic oligonucleotide
  Target: SOD1; (+) strand; PAM type: YTN; PAM sequence: TTT
ttttttttaaagtcaagtga

SEQ ID NO: 16025 - DNA, 20 bp, Artificial Sequence
  Description of Artificial Sequence: Synthetic oligonucleotide
  Target: SOD1; (+) strand; PAM type: YTN; PAM sequence: TTT
tttttttaaagtcaagtgag

SEQ ID NO: 16026 - DNA, 20 bp, Artificial Sequence
  Description of Artificial Sequence: Synthetic oligonucleotide
  Target: SOD1; (+) strand; PAM type: YTN; PAM sequence: TTT
ttttttaaagtcaagtgagt

SEQ ID NO: 16027 - DNA, 20 bp, Artificial Sequence
  Description of Artificial Sequence: Synthetic oligonucleotide
  Target: SOD1; (+) strand; PAM type: YTN; PAM sequence: TTT
tttttaaagtcaagtgagta

SEQ ID NO: 16028 - DNA, 20 bp, Artificial Sequence
  Description of Artificial Sequence: Synthetic oligonucleotide
  Target: SOD1; (+) strand; PAM type: YTN; PAM sequence: TTT
ttttaaagtcaagtgagtat

SEQ ID NO: 16029 - DNA, 20 bp, Artificial Sequence
  Description of Artificial Sequence: Synthetic oligonucleotide
  Target: SOD1; (+) strand; PAM type: YTN; PAM sequence: TTT
tttaaagtcaagtgagtatg

SEQ ID NO: 16030 - DNA, 20 bp, Artificial Sequence
  Description of Artificial Sequence: Synthetic oligonucleotide
  Target: SOD1; (+) strand; PAM type: YTN; PAM sequence: TTT
ttaaagtcaagtgagtatgc

SEQ ID NO: 16031 - DNA, 20 bp, Artificial Sequence
  Description of Artificial Sequence: Synthetic oligonucleotide
  Target: SOD1; (+) strand; PAM type: YTN; PAM sequence: TTT
taaagtcaagtgagtatgcc

SEQ ID NO: 16032 - DNA, 20 bp, Artificial Sequence
  Description of Artificial Sequence: Synthetic oligonucleotide
  Target: SOD1; (+) strand; PAM type: YTN; PAM sequence: TTT
aaagtcaagtgagtatgcca

SEQ ID NO: 16033 - DNA, 20 bp, Artificial Sequence
  Description of Artificial Sequence: Synthetic oligonucleotide
  Target: SOD1; (+) strand; PAM type: YTN; PAM sequence: TTA
aagtcaagtgagtatgccat

SEQ ID NO: 16034 - DNA, 20 bp, Artificial Sequence
  Description of Artificial Sequence: Synthetic oligonucleotide
  Target: SOD1; (+) strand; PAM type: YTN; PAM sequence: CTC
cagagtgtaggatgagacat

SEQ ID NO: 16035 - DNA, 20 bp, Artificial Sequence
  Description of Artificial Sequence: Synthetic oligonucleotide
  Target: SOD1; (+) strand; PAM type: YTN; PAM sequence: CTT
ttgggttaaaaaggctgagg

SEQ ID NO: 16036 - DNA, 20 bp, Artificial Sequence
  Description of Artificial Sequence: Synthetic oligonucleotide
  Target: SOD1; (+) strand; PAM type: YTN; PAM sequence: TTT
tgggttaaaaaggctgaggc

SEQ ID NO: 16037 - DNA, 20 bp, Artificial Sequence
  Description of Artificial Sequence: Synthetic oligonucleotide
  Target: SOD1; (+) strand; PAM type: YTN; PAM sequence: TTT
gggttaaaaaggctgaggca

SEQ ID NO: 16038 - DNA, 20 bp, Artificial Sequence
  Description of Artificial Sequence: Synthetic oligonucleotide
  Target: SOD1; (+) strand; PAM type: YTN; PAM sequence: TTG
ggttaaaaaggctgaggcag

SEQ ID NO: 16039 - DNA, 20 bp, Artificial Sequence
  Description of Artificial Sequence: Synthetic oligonucleotide
  Target: SOD1; (+) strand; PAM type: YTN; PAM sequence: TTA
aaaaggctgaggcaggagaa

SEQ ID NO: 16040 - DNA, 20 bp, Artificial Sequence
  Description of Artificial Sequence: Synthetic oligonucleotide
  Target: SOD1; (+) strand; PAM type: YTN; PAM sequence: CTG
aggcaggagaatggcgtgaa

SEQ ID NO: 16041 - DNA, 20 bp, Artificial Sequence
  Description of Artificial Sequence: Synthetic oligonucleotide
  Target: SOD1; (+) strand; PAM type: YTN; PAM sequence: CTT
gcagtgagctgagatcatgc

SEQ ID NO: 16042 - DNA, 20 bp, Artificial Sequence
  Description of Artificial Sequence: Synthetic oligonucleotide
  Target: SOD1; (+) strand; PAM type: YTN; PAM sequence: TTG
cagtgagctgagatcatgcc

SEQ ID NO: 16043 - DNA, 20 bp, Artificial Sequence
  Description of Artificial Sequence: Synthetic oligonucleotide
  Target: SOD1; (+) strand; PAM type: YTN; PAM sequence: CTG
agatcatgccactgcactcc

SEQ ID NO: 16044 - DNA, 20 bp, Artificial Sequence
  Description of Artificial Sequence: Synthetic oligonucleotide
  Target: SOD1; (+) strand; PAM type: YTN; PAM sequence: CTG
cactccagcctgggcgacag

SEQ ID NO: 16045 - DNA, 20 bp, Artificial Sequence
  Description of Artificial Sequence: Synthetic oligonucleotide
  Target: SOD1; (+) strand; PAM type: YTN; PAM sequence: CTC
cagcctgggcgacagagcga

SEQ ID NO: 16046 - DNA, 20 bp, Artificial Sequence
  Description of Artificial Sequence: Synthetic oligonucleotide
  Target: SOD1; (+) strand; PAM type: YTN; PAM sequence: CTG
ggcgacagagcgagactctt

SEQ ID NO: 16047 - DNA, 20 bp, Artificial Sequence
  Description of Artificial Sequence: Synthetic oligonucleotide
  Target: SOD1; (+) strand; PAM type: YTN; PAM sequence: CTC
ttgtctcaaaataaaaaacg

SEQ ID NO: 16048 - DNA, 20 bp, Artificial Sequence
  Description of Artificial Sequence: Synthetic oligonucleotide
  Target: SOD1; (+) strand; PAM type: YTN; PAM sequence: CTT
gtctcaaaataaaaaacgtt

SEQ ID NO: 16049 - DNA, 20 bp, Artificial Sequence
  Description of Artificial Sequence: Synthetic oligonucleotide
  Target: SOD1; (+) strand; PAM type: YTN; PAM sequence: TTG
tctcaaaataaaaaacgttt

SEQ ID NO: 16050 - DNA, 20 bp, Artificial Sequence
  Description of Artificial Sequence: Synthetic oligonucleotide
  Target: SOD1; (+) strand; PAM type: YTN; PAM sequence: CTC
aaaataaaaaacgtttacat

SEQ ID NO: 16051 - DNA, 20 bp, Artificial Sequence
  Description of Artificial Sequence: Synthetic oligonucleotide
  Target: SOD1; (+) strand; PAM type: YTN; PAM sequence: TTT
acatgtacatgtatattcaa

SEQ ID NO: 16052 - DNA, 20 bp, Artificial Sequence
  Description of Artificial Sequence: Synthetic oligonucleotide
  Target: SOD1; (+) strand; PAM type: YTN; PAM sequence: TTA
catgtacatgtatattcaac

SEQ ID NO: 16053 - DNA, 20 bp, Artificial Sequence
  Description of Artificial Sequence: Synthetic oligonucleotide
  Target: SOD1; (+) strand; PAM type: YTN; PAM sequence: TTC
aacatgtacaaatataacct

SEQ ID NO: 16054 - DNA, 20 bp, Artificial Sequence
  Description of Artificial Sequence: Synthetic oligonucleotide
  Target: SOD1; (+) strand; PAM type: YTN; PAM sequence: CTA
ttcaaaagtatttactacat

SEQ ID NO: 16055 - DNA, 20 bp, Artificial Sequence
  Description of Artificial Sequence: Synthetic oligonucleotide
  Target: SOD1; (+) strand; PAM type: YTN; PAM sequence: TTC
aaaagtatttactacataaa

SEQ ID NO: 16056 - DNA, 20 bp, Artificial Sequence
  Description of Artificial Sequence: Synthetic oligonucleotide
  Target: SOD1; (+) strand; PAM type: YTN; PAM sequence: TTT
actacataaataggtactta

SEQ ID NO: 16057 - DNA, 20 bp, Artificial Sequence
  Description of Artificial Sequence: Synthetic oligonucleotide
  Target: SOD1; (+) strand; PAM type: YTN; PAM sequence: TTA
ctacataaataggtacttac

SEQ ID NO: 16058 - DNA, 20 bp, Artificial Sequence
  Description of Artificial Sequence: Synthetic oligonucleotide
  Target: SOD1; (+) strand; PAM type: YTN; PAM sequence: CTA
cataaataggtacttacatt

SEQ ID NO: 16059 - DNA, 20 bp, Artificial Sequence
  Description of Artificial Sequence: Synthetic oligonucleotide
  Target: SOD1; (+) strand; PAM type: YTN; PAM sequence: CTT
acattacctatttactgtaa

SEQ ID NO: 16060 - DNA, 20 bp, Artificial Sequence
  Description of Artificial Sequence: Synthetic oligonucleotide
  Target: SOD1; (+) strand; PAM type: YTN; PAM sequence: TTA
cattacctatttactgtaat

SEQ ID NO: 16061 - DNA, 20 bp, Artificial Sequence
  Description of Artificial Sequence: Synthetic oligonucleotide
  Target: SOD1; (+) strand; PAM type: YTN; PAM sequence: TTA
cctatttactgtaatagtca

SEQ ID NO: 16062 - DNA, 20 bp, Artificial Sequence
  Description of Artificial Sequence: Synthetic oligonucleotide
  Target: SOD1; (+) strand; PAM type: YTN; PAM sequence: CTA
tttactgtaatagtcaaagc

SEQ ID NO: 16063 - DNA, 20 bp, Artificial Sequence
  Description of Artificial Sequence: Synthetic oligonucleotide
  Target: SOD1; (+) strand; PAM type: YTN; PAM sequence: TTT
actgtaatagtcaaagccta

SEQ ID NO: 16064 - DNA, 20 bp, Artificial Sequence
  Description of Artificial Sequence: Synthetic oligonucleotide
  Target: SOD1; (+) strand; PAM type: YTN; PAM sequence: TTA
ctgtaatagtcaaagcctat

SEQ ID NO: 16065 - DNA, 20 bp, Artificial Sequence
  Description of Artificial Sequence: Synthetic oligonucleotide
  Target: SOD1; (+) strand; PAM type: YTN; PAM sequence: CTG
taatagtcaaagcctatgaa

SEQ ID NO: 16066 - DNA, 20 bp, Artificial Sequence
  Description of Artificial Sequence: Synthetic oligonucleotide
  Target: SOD1; (+) strand; PAM type: YTN; PAM sequence: CTA
tgaagtatctaacactgatg

SEQ ID NO: 16067 - DNA, 20 bp, Artificial Sequence
  Description of Artificial Sequence: Synthetic oligonucleotide
  Target: SOD1; (+) strand; PAM type: YTN; PAM sequence: CTA
acactgatgtgtaggtactc

SEQ ID NO: 16068 - DNA, 20 bp, Artificial Sequence
  Description of Artificial Sequence: Synthetic oligonucleotide
  Target: SOD1; (+) strand; PAM type: YTN; PAM sequence: CTG
atgtgtaggtactcactttg

SEQ ID NO: 16069 - DNA, 20 bp, Artificial Sequence
  Description of Artificial Sequence: Synthetic oligonucleotide
  Target: SOD1; (+) strand; PAM type: YTN; PAM sequence: CTC
actttgcttgccactctatt

SEQ ID NO: 16070 - DNA, 20 bp, Artificial Sequence
  Description of Artificial Sequence: Synthetic oligonucleotide
  Target: SOD1; (+) strand; PAM type: YTN; PAM sequence: CTT
tgcttgccactctattaggt

SEQ ID NO: 16071 - DNA, 20 bp, Artificial Sequence
  Description of Artificial Sequence: Synthetic oligonucleotide
  Target: SOD1; (+) strand; PAM type: YTN; PAM sequence: TTT
gcttgccactctattaggtg

SEQ ID NO: 16072 - DNA, 20 bp, Artificial Sequence
  Description of Artificial Sequence: Synthetic oligonucleotide
  Target: SOD1; (+) strand; PAM type: YTN; PAM sequence: TTG
cttgccactctattaggtgc

SEQ ID NO: 16073 - DNA, 20 bp, Artificial Sequence
  Description of Artificial Sequence: Synthetic oligonucleotide
  Target: SOD1; (+) strand; PAM type: YTN; PAM sequence: CTT
gccactctattaggtgcttt

SEQ ID NO: 16074 - DNA, 20 bp, Artificial Sequence
  Description of Artificial Sequence: Synthetic oligonucleotide
  Target: SOD1; (+) strand; PAM type: YTN; PAM sequence: TTG
ccactctattaggtgctttt

SEQ ID NO: 16075 - DNA, 20 bp, Artificial Sequence
  Description of Artificial Sequence: Synthetic oligonucleotide
  Target: SOD1; (+) strand; PAM type: YTN; PAM sequence: CTC
tattaggtgctttttatgtt

SEQ ID NO: 16076 - DNA, 20 bp, Artificial Sequence
  Description of Artificial Sequence: Synthetic oligonucleotide
  Target: SOD1; (+) strand; PAM type: YTN; PAM sequence: CTA
ttaggtgctttttatgttat

SEQ ID NO: 16077 - DNA, 20 bp, Artificial Sequence
  Description of Artificial Sequence: Synthetic oligonucleotide
  Target: SOD1; (+) strand; PAM type: YTN; PAM sequence: TTA
ggtgctttttatgttattta

SEQ ID NO: 16078 - DNA, 20 bp, Artificial Sequence
  Description of Artificial Sequence: Synthetic oligonucleotide
  Target: SOD1; (+) strand; PAM type: YTN; PAM sequence: CTT
tttatgttatttaatcatga

SEQ ID NO: 16079 - DNA, 20 bp, Artificial Sequence
  Description of Artificial Sequence: Synthetic oligonucleotide
  Target: SOD1; (+) strand; PAM type: YTN; PAM sequence: TTT
ttatgttatttaatcatgaa

SEQ ID NO: 16080 - DNA, 20 bp, Artificial Sequence
  Description of Artificial Sequence: Synthetic oligonucleotide
  Target: SOD1; (+) strand; PAM type: YTN; PAM sequence: TTT
tatgttatttaatcatgaag

SEQ ID NO: 16081 - DNA, 20 bp, Artificial Sequence
  Description of Artificial Sequence: Synthetic oligonucleotide
  Target: SOD1; (+) strand; PAM type: YTN; PAM sequence: TTT
atgttatttaatcatgaagc

SEQ ID NO: 16082 - DNA, 20 bp, Artificial Sequence
  Description of Artificial Sequence: Synthetic oligonucleotide
  Target: SOD1; (+) strand; PAM type: YTN; PAM sequence: TTA
tgttatttaatcatgaagcc

SEQ ID NO: 16083 - DNA, 20 bp, Artificial Sequence
  Description of Artificial Sequence: Synthetic oligonucleotide
  Target: SOD1; (+) strand; PAM type: YTN; PAM sequence: TTA
tttaatcatgaagcctggcc

SEQ ID NO: 16084 - DNA, 20 bp, Artificial Sequence
  Description of Artificial Sequence: Synthetic oligonucleotide
  Target: SOD1; (+) strand; PAM type: YTN; PAM sequence: TTT
aatcatgaagcctggccaca

SEQ ID NO: 16085 - DNA, 20 bp, Artificial Sequence
  Description of Artificial Sequence: Synthetic oligonucleotide
  Target: SOD1; (+) strand; PAM type: YTN; PAM sequence: TTA
atcatgaagcctggccacag

SEQ ID NO: 16086 - DNA, 20 bp, Artificial Sequence
  Description of Artificial Sequence: Synthetic oligonucleotide
  Target: SOD1; (+) strand; PAM type: YTN; PAM sequence: CTG
gccacagggtgcttgtgcat

SEQ ID NO: 16087 - DNA, 20 bp, Artificial Sequence
  Description of Artificial Sequence: Synthetic oligonucleotide
  Target: SOD1; (+) strand; PAM type: YTN; PAM sequence: CTT
gtgcattgagtgtgggaaca

SEQ ID NO: 16088 - DNA, 20 bp, Artificial Sequence
  Description of Artificial Sequence: Synthetic oligonucleotide
  Target: SOD1; (+) strand; PAM type: YTN; PAM sequence: TTG
tgcattgagtgtgggaacaa

SEQ ID NO: 16089 - DNA, 20 bp, Artificial Sequence
  Description of Artificial Sequence: Synthetic oligonucleotide
  Target: SOD1; (+) strand; PAM type: YTN; PAM sequence: TTG
agtgtgggaacaagattacc

SEQ ID NO: 16090 - DNA, 20 bp, Artificial Sequence
  Description of Artificial Sequence: Synthetic oligonucleotide
  Target: SOD1; (+) strand; PAM type: YTN; PAM sequence: TTA
ccatctcccttttgaggaca

SEQ ID NO: 16091 - DNA, 20 bp, Artificial Sequence
  Description of Artificial Sequence: Synthetic oligonucleotide
  Target: SOD1; (+) strand; PAM type: YTN; PAM sequence: CTC
ccttttgaggacacaggcct

SEQ ID NO: 16092 - DNA, 20 bp, Artificial Sequence
  Description of Artificial Sequence: Synthetic oligonucleotide
  Target: SOD1; (+) strand; PAM type: YTN; PAM sequence: CTT
ttgaggacacaggcctagag

SEQ ID NO: 16093 - DNA, 20 bp, Artificial Sequence
  Description of Artificial Sequence: Synthetic oligonucleotide
  Target: SOD1; (+) strand; PAM type: YTN; PAM sequence: TTT
tgaggacacaggcctagagc

SEQ ID NO: 16094 - DNA, 20 bp, Artificial Sequence
  Description of Artificial Sequence: Synthetic oligonucleotide
  Target: SOD1; (+) strand; PAM type: YTN; PAM sequence: TTT
gaggacacaggcctagagca

SEQ ID NO: 16095 - DNA, 20 bp, Artificial Sequence
  Description of Artificial Sequence: Synthetic oligonucleotide
  Target: SOD1; (+) strand; PAM type: YTN; PAM sequence: TTG
aggacacaggcctagagcag

SEQ ID NO: 16096 - DNA, 20 bp, Artificial Sequence
  Description of Artificial Sequence: Synthetic oligonucleotide
  Target: SOD1; (+) strand; PAM type: YTN; PAM sequence: CTA
gagcagttaagcagcttgct

SEQ ID NO: 16097 - DNA, 20 bp, Artificial Sequence
  Description of Artificial Sequence: Synthetic oligonucleotide
  Target: SOD1; (+) strand; PAM type: YTN; PAM sequence: TTA
agcagcttgctggaggttca

SEQ ID NO: 16098 - DNA, 20 bp, Artificial Sequence
  Description of Artificial Sequence: Synthetic oligonucleotide
  Target: SOD1; (+) strand; PAM type: YTN; PAM sequence: CTT
gctggaggttcactggctag

SEQ ID NO: 16099 - DNA, 20 bp, Artificial Sequence
  Description of Artificial Sequence: Synthetic oligonucleotide
  Target: SOD1; (+) strand; PAM type: YTN; PAM sequence: TTG
ctggaggttcactggctaga

SEQ ID NO: 16100 - DNA, 20 bp, Artificial Sequence
  Description of Artificial Sequence: Synthetic oligonucleotide
  Target: SOD1; (+) strand; PAM type: YTN; PAM sequence: CTG
gaggttcactggctagaaag

SEQ ID NO: 16101 - DNA, 20 bp, Artificial Sequence
  Description of Artificial Sequence: Synthetic oligonucleotide
  Target: SOD1; (+) strand; PAM type: YTN; PAM sequence: TTC
actggctagaaagtggtcag

SEQ ID NO: 16102 - DNA, 20 bp, Artificial Sequence
  Description of Artificial Sequence: Synthetic oligonucleotide
  Target: SOD1; (+) strand; PAM type: YTN; PAM sequence: CTG
gctagaaagtggtcagcctg

SEQ ID NO: 16103 - DNA, 20 bp, Artificial Sequence
  Description of Artificial Sequence: Synthetic oligonucleotide
  Target: SOD1; (+) strand; PAM type: YTN; PAM sequence: CTA
gaaagtggtcagcctgggat

SEQ ID NO: 16104 - DNA, 20 bp, Artificial Sequence
  Description of Artificial Sequence: Synthetic oligonucleotide
  Target: SOD1; (+) strand; PAM type: YTN; PAM sequence: CTG
ggatttggacacagattttt

SEQ ID NO: 16105 - DNA, 20 bp, Artificial Sequence
  Description of Artificial Sequence: Synthetic oligonucleotide
  Target: SOD1; (+) strand; PAM type: YTN; PAM sequence: TTT
ggacacagatttttccactc

SEQ ID NO: 16106 - DNA, 20 bp, Artificial Sequence
  Description of Artificial Sequence: Synthetic oligonucleotide
  Target: SOD1; (+) strand; PAM type: YTN; PAM sequence: TTG
gacacagatttttccactcc

SEQ ID NO: 16107 - DNA, 20 bp, Artificial Sequence
  Description of Artificial Sequence: Synthetic oligonucleotide
  Target: SOD1; (+) strand; PAM type: YTN; PAM sequence: TTT
ttccactcccaagtctggct

SEQ ID NO: 16108 - DNA, 20 bp, Artificial Sequence
  Description of Artificial Sequence: Synthetic oligonucleotide
  Target: SOD1; (+) strand; PAM type: YTN; PAM sequence: TTT
tccactcccaagtctggctg

SEQ ID NO: 16109 - DNA, 20 bp, Artificial Sequence
  Description of Artificial Sequence: Synthetic oligonucleotide
  Target: SOD1; (+) strand; PAM type: YTN; PAM sequence: TTT
ccactcccaagtctggctgc

SEQ ID NO: 16110 - DNA, 20 bp, Artificial Sequence
  Description of Artificial Sequence: Synthetic oligonucleotide
  Target: SOD1; (+) strand; PAM type: YTN; PAM sequence: TTC
cactcccaagtctggctgct

SEQ ID NO: 16111 - DNA, 20 bp, Artificial Sequence
  Description of Artificial Sequence: Synthetic oligonucleotide
  Target: SOD1; (+) strand; PAM type: YTN; PAM sequence: CTC
ccaagtctggctgcttttta

SEQ ID NO: 16112 - DNA, 20 bp, Artificial Sequence
  Description of Artificial Sequence: Synthetic oligonucleotide
  Target: SOD1; (+) strand; PAM type: YTN; PAM sequence: CTG
gctgctttttacttcactgt

SEQ ID NO: 16113 - DNA, 20 bp, Artificial Sequence
  Description of Artificial Sequence: Synthetic oligonucleotide
  Target: SOD1; (+) strand; PAM type: YTN; PAM sequence: CTG
ctttttacttcactgtgagg

SEQ ID NO: 16114 - DNA, 20 bp, Artificial Sequence
  Description of Artificial Sequence: Synthetic oligonucleotide
  Target: SOD1; (+) strand; PAM type: YTN; PAM sequence: CTT
tttacttcactgtgaggggt

SEQ ID NO: 16115 - DNA, 20 bp, Artificial Sequence
  Description of Artificial Sequence: Synthetic oligonucleotide
  Target: SOD1; (+) strand; PAM type: YTN; PAM sequence: TTT
ttacttcactgtgaggggta

SEQ ID NO: 16116 - DNA, 20 bp, Artificial Sequence
  Description of Artificial Sequence: Synthetic oligonucleotide
  Target: SOD1; (+) strand; PAM type: YTN; PAM sequence: TTT
tacttcactgtgaggggtaa

SEQ ID NO: 16117 - DNA, 20 bp, Artificial Sequence
  Description of Artificial Sequence: Synthetic oligonucleotide
  Target: SOD1; (+) strand; PAM type: YTN; PAM sequence: TTT
acttcactgtgaggggtaaa

SEQ ID NO: 16118 - DNA, 20 bp, Artificial Sequence
  Description of Artificial Sequence: Synthetic oligonucleotide
  Target: SOD1; (+) strand; PAM type: YTN; PAM sequence: TTA
cttcactgtgaggggtaaag

SEQ ID NO: 16119 - DNA, 20 bp, Artificial Sequence
  Description of Artificial Sequence: Synthetic oligonucleotide
  Target: SOD1; (+) strand; PAM type: YTN; PAM sequence: CTT
cactgtgaggggtaaaggta

SEQ ID NO: 16120 - DNA, 20 bp, Artificial Sequence
  Description of Artificial Sequence: Synthetic oligonucleotide
  Target: SOD1; (+) strand; PAM type: YTN; PAM sequence: TTC
actgtgaggggtaaaggtaa

SEQ ID NO: 16121 - DNA, 20 bp, Artificial Sequence
  Description of Artificial Sequence: Synthetic oligonucleotide
  Target: SOD1; (+) strand; PAM type: YTN; PAM sequence: CTG
tgaggggtaaaggtaaatca

SEQ ID NO: 16122 - DNA, 20 bp, Artificial Sequence
  Description of Artificial Sequence: Synthetic oligonucleotide
  Target: SOD1; (+) strand; PAM type: YTN; PAM sequence: CTG
ttttctttgttcagaaactc

SEQ ID NO: 16123 - DNA, 20 bp, Artificial Sequence
  Description of Artificial Sequence: Synthetic oligonucleotide
  Target: SOD1; (+) strand; PAM type: YTN; PAM sequence: TTT
tctttgttcagaaactctct

SEQ ID NO: 16124 - DNA, 20 bp, Artificial Sequence
  Description of Artificial Sequence: Synthetic oligonucleotide
  Target: SOD1; (+) strand; PAM type: YTN; PAM sequence: TTT
ctttgttcagaaactctctc

SEQ ID NO: 16125 - DNA, 20 bp, Artificial Sequence
  Description of Artificial Sequence: Synthetic oligonucleotide
  Target: SOD1; (+) strand; PAM type: YTN; PAM sequence: TTC
tttgttcagaaactctctcc

SEQ ID NO: 16126 - DNA, 20 bp, Artificial Sequence
  Description of Artificial Sequence: Synthetic oligonucleotide
  Target: SOD1; (+) strand; PAM type: YTN; PAM sequence: CTT
tgttcagaaactctctccaa

SEQ ID NO: 16127 - DNA, 20 bp, Artificial Sequence
  Description of Artificial Sequence: Synthetic oligonucleotide
  Target: SOD1; (+) strand; PAM type: YTN; PAM sequence: TTT
gttcagaaactctctccaac

SEQ ID NO: 16128 - DNA, 20 bp, Artificial Sequence
  Description of Artificial Sequence: Synthetic oligonucleotide
  Target: SOD1; (+) strand; PAM type: YTN; PAM sequence: TTG
ttcagaaactctctccaact

SEQ ID NO: 16129 - DNA, 20 bp, Artificial Sequence
  Description of Artificial Sequence: Synthetic oligonucleotide
  Target: SOD1; (+) strand; PAM type: YTN; PAM sequence: TTC
agaaactctctccaactttg

SEQ ID NO: 16130 - DNA, 20 bp, Artificial Sequence
  Description of Artificial Sequence: Synthetic oligonucleotide
  Target: SOD1; (+) strand; PAM type: YTN; PAM sequence: CTC
tctccaactttgcacttttc

SEQ ID NO: 16131 - DNA, 20 bp, Artificial Sequence
  Description of Artificial Sequence: Synthetic oligonucleotide
  Target: SOD1; (+) strand; PAM type: YTN; PAM sequence: CTC
tccaactttgcacttttctt

SEQ ID NO: 16132 - DNA, 20 bp, Artificial Sequence
  Description of Artificial Sequence: Synthetic oligonucleotide
  Target: SOD1; (+) strand; PAM type: YTN; PAM sequence: CTC
caactttgcacttttcttaa

SEQ ID NO: 16133 - DNA, 20 bp, Artificial Sequence
  Description of Artificial Sequence: Synthetic oligonucleotide
  Target: SOD1; (+) strand; PAM type: YTN; PAM sequence: CTT
tgcacttttcttaaaggaaa

SEQ ID NO: 16134 - DNA, 20 bp, Artificial Sequence
  Description of Artificial Sequence: Synthetic oligonucleotide
  Target: SOD1; (+) strand; PAM type: YTN; PAM sequence: TTT
gcacttttcttaaaggaaag

SEQ ID NO: 16135 - DNA, 20 bp, Artificial Sequence
  Description of Artificial Sequence: Synthetic oligonucleotide
  Target: SOD1; (+) strand; PAM type: YTN; PAM sequence: TTG
cacttttcttaaaggaaagt

SEQ ID NO: 16136 - DNA, 20 bp, Artificial Sequence
  Description of Artificial Sequence: Synthetic oligonucleotide
  Target: SOD1; (+) strand; PAM type: YTN; PAM sequence: CTT
ttcttaaaggaaagtaatgg

SEQ ID NO: 16137 - DNA, 20 bp, Artificial Sequence
  Description of Artificial Sequence: Synthetic oligonucleotide
  Target: SOD1; (+) strand; PAM type: YTN; PAM sequence: TTT
tcttaaaggaaagtaatgga

SEQ ID NO: 16138 - DNA, 20 bp, Artificial Sequence
  Description of Artificial Sequence: Synthetic oligonucleotide
  Target: SOD1; (+) strand; PAM type: YTN; PAM sequence: TTT
cttaaaggaaagtaatggac

SEQ ID NO: 16139 - DNA, 20 bp, Artificial Sequence
  Description of Artificial Sequence: Synthetic oligonucleotide
  Target: SOD1; (+) strand; PAM type: YTN; PAM sequence: TTC
ttaaaggaaagtaatggacc

SEQ ID NO: 16140 - DNA, 20 bp, Artificial Sequence
  Description of Artificial Sequence: Synthetic oligonucleotide
  Target: SOD1; (+) strand; PAM type: YTN; PAM sequence: CTT
aaaggaaagtaatggaccag

SEQ ID NO: 16141 - DNA, 20 bp, Artificial Sequence
  Description of Artificial Sequence: Synthetic oligonucleotide
  Target: SOD1; (+) strand; PAM type: YTN; PAM sequence: TTA
aaggaaagtaatggaccagt

SEQ ID NO: 16142 - DNA, 20 bp, Artificial Sequence
  Description of Artificial Sequence: Synthetic oligonucleotide
  Target: SOD1; (+) strand; PAM type: YTN; PAM sequence: TTA
aaggactgactgaaggcctg

SEQ ID NO: 16143 - DNA, 20 bp, Artificial Sequence
  Description of Artificial Sequence: Synthetic oligonucleotide
  Target: SOD1; (+) strand; PAM type: YTN; PAM sequence: CTG
actgaaggcctgcatggatt

SEQ ID NO: 16144 - DNA, 20 bp, Artificial Sequence
  Description of Artificial Sequence: Synthetic oligonucleotide
  Target: SOD1; (+) strand; PAM type: YTN; PAM sequence: CTG
aaggcctgcatggattccat

SEQ ID NO: 16145 - DNA, 20 bp, Artificial Sequence
  Description of Artificial Sequence: Synthetic oligonucleotide
  Target: SOD1; (+) strand; PAM type: YTN; PAM sequence: CTG
catggattccatgttcatga

SEQ ID NO: 16146 - DNA, 20 bp, Artificial Sequence
  Description of Artificial Sequence: Synthetic oligonucleotide
  Target: SOD1; (+) strand; PAM type: YTN; PAM sequence: TTC
catgttcatgagtttggaga

SEQ ID NO: 16147 - DNA, 20 bp, Artificial Sequence
  Description of Artificial Sequence: Synthetic oligonucleotide
  Target: SOD1; (+) strand; PAM type: YTN; PAM sequence: TTC
atgagtttggagataataca

SEQ ID NO: 16148 - DNA, 20 bp, Artificial Sequence
  Description of Artificial Sequence: Synthetic oligonucleotide
  Target: SOD1; (+) strand; PAM type: YTN; PAM sequence: TTT
ggagataatacagcaggtgg

SEQ ID NO: 16149 - DNA, 20 bp, Artificial Sequence
  Description of Artificial Sequence: Synthetic oligonucleotide
  Target: SOD1; (+) strand; PAM type: YTN; PAM sequence: TTG
gagataatacagcaggtggg

SEQ ID NO: 16150 - DNA, 20 bp, Artificial Sequence
  Description of Artificial Sequence: Synthetic oligonucleotide
  Target: SOD1; (+) strand; PAM type: YTN; PAM sequence: TTG
tgctgtgctggtgacccata

SEQ ID NO: 16151 - DNA, 20 bp, Artificial Sequence
  Description of Artificial Sequence: Synthetic oligonucleotide
  Target: SOD1; (+) strand; PAM type: YTN; PAM sequence: CTG
tgctggtgacccatacttgt

SEQ ID NO: 16152 - DNA, 20 bp, Artificial Sequence
  Description of Artificial Sequence: Synthetic oligonucleotide
  Target: SOD1; (+) strand; PAM type: YTN; PAM sequence: CTG
gtgacccatacttgttcacc

SEQ ID NO: 16153 - DNA, 20 bp, Artificial Sequence
  Description of Artificial Sequence: Synthetic oligonucleotide
  Target: SOD1; (+) strand; PAM type: YTN; PAM sequence: CTT
gttcaccctagttagataaa

SEQ ID NO: 16154 - DNA, 20 bp, Artificial Sequence
  Description of Artificial Sequence: Synthetic oligonucleotide
  Target: SOD1; (+) strand; PAM type: YTN; PAM sequence: TTG
ttcaccctagttagataaac

SEQ ID NO: 16155 - DNA, 20 bp, Artificial Sequence
  Description of Artificial Sequence: Synthetic oligonucleotide
  Target: SOD1; (+) strand; PAM type: YTN; PAM sequence: TTC
accctagttagataaacagt

SEQ ID NO: 16156 - DNA, 20 bp, Artificial Sequence
  Description of Artificial Sequence: Synthetic oligonucleotide
  Target: SOD1; (+) strand; PAM type: YTN; PAM sequence: CTA
gttagataaacagtagagta

SEQ ID NO: 16157 - DNA, 20 bp, Artificial Sequence
  Description of Artificial Sequence: Synthetic oligonucleotide
  Target: SOD1; (+) strand; PAM type: YTN; PAM sequence: TTA
gataaacagtagagtagccc

SEQ ID NO: 16158 - DNA, 20 bp, Artificial Sequence
  Description of Artificial Sequence: Synthetic oligonucleotide
  Target: SOD1; (+) strand; PAM type: YTN; PAM sequence: CTA
aacgttaaaacccctcaact

SEQ ID NO: 16159 - DNA, 20 bp, Artificial Sequence
  Description of Artificial Sequence: Synthetic oligonucleotide
  Target: SOD1; (+) strand; PAM type: YTN; PAM sequence: TTA
aaacccctcaacttgttttt

SEQ ID NO: 16160 - DNA, 20 bp, Artificial Sequence
  Description of Artificial Sequence: Synthetic oligonucleotide
  Target: SOD1; (+) strand; PAM type: YTN; PAM sequence: CTC
aacttgtttttgtttttgag

SEQ ID NO: 16161 - DNA, 20 bp, Artificial Sequence
  Description of Artificial Sequence: Synthetic oligonucleotide
  Target: SOD1; (+) strand; PAM type: YTN; PAM sequence: CTT
gtttttgtttttgagaaagg

SEQ ID NO: 16162 - DNA, 20 bp, Artificial Sequence
  Description of Artificial Sequence: Synthetic oligonucleotide
  Target: SOD1; (+) strand; PAM type: YTN; PAM sequence: TTG
tttttgtttttgagaaaggg

SEQ ID NO: 16163 - DNA, 20 bp, Artificial Sequence
  Description of Artificial Sequence: Synthetic oligonucleotide
  Target: SOD1; (+) strand; PAM type: YTN; PAM sequence: TTT
ttgtttttgagaaagggtct

SEQ ID NO: 16164 - DNA, 20 bp, Artificial Sequence
  Description of Artificial Sequence: Synthetic oligonucleotide
  Target: SOD1; (+) strand; PAM type: YTN; PAM sequence: TTT
tgtttttgagaaagggtctt

SEQ ID NO: 16165 - DNA, 20 bp, Artificial Sequence
  Description of Artificial Sequence: Synthetic oligonucleotide
  Target: SOD1; (+) strand; PAM type: YTN; PAM sequence: TTT
gtttttgagaaagggtcttg

SEQ ID NO: 16166 - DNA, 20 bp, Artificial Sequence
  Description of Artificial Sequence: Synthetic oligonucleotide
  Target: SOD1; (+) strand; PAM type: YTN; PAM sequence: TTG
tttttgagaaagggtcttgc

SEQ ID NO: 16167 - DNA, 20 bp, Artificial Sequence
  Description of Artificial Sequence: Synthetic oligonucleotide
  Target: SOD1; (+) strand; PAM type: YTN; PAM sequence: TTT
ttgagaaagggtcttgctct

SEQ ID NO: 16168 - DNA, 20 bp, Artificial Sequence
  Description of Artificial Sequence: Synthetic oligonucleotide
  Target: SOD1; (+) strand; PAM type: YTN; PAM sequence: TTT
tgagaaagggtcttgctctg

SEQ ID NO: 16169 - DNA, 20 bp, Artificial Sequence
  Description of Artificial Sequence: Synthetic oligonucleotide
  Target: SOD1; (+) strand; PAM type: YTN; PAM sequence: TTT
gagaaagggtcttgctctgt

SEQ ID NO: 16170 - DNA, 20 bp, Artificial Sequence
  Description of Artificial Sequence: Synthetic oligonucleotide
  Target: SOD1; (+) strand; PAM type: YTN; PAM sequence: TTG
agaaagggtcttgctctgtc

SEQ ID NO: 16171 - DNA, 20 bp, Artificial Sequence
  Description of Artificial Sequence: Synthetic oligonucleotide
  Target: SOD1; (+) strand; PAM type: YTN; PAM sequence: CTT
gctctgtcgctcaggctgga

SEQ ID NO: 16172 - DNA, 20 bp, Artificial Sequence
  Description of Artificial Sequence: Synthetic oligonucleotide
  Target: SOD1; (+) strand; PAM type: YTN; PAM sequence: TTG
ctctgtcgctcaggctggag

SEQ ID NO: 16173 - DNA, 20 bp, Artificial Sequence
  Description of Artificial Sequence: Synthetic oligonucleotide
  Target: SOD1; (+) strand; PAM type: YTN; PAM sequence: CTC
tgtcgctcaggctggagtgc

SEQ ID NO: 16174 - DNA, 20 bp, Artificial Sequence
  Description of Artificial Sequence: Synthetic oligonucleotide
  Target: SOD1; (+) strand; PAM type: YTN; PAM sequence: CTG
tcgctcaggctggagtgcag

SEQ ID NO: 16175 - DNA, 20 bp, Artificial Sequence
  Description of Artificial Sequence: Synthetic oligonucleotide
  Target: SOD1; (+) strand; PAM type: YTN; PAM sequence: CTC
aggctggagtgcagtggcgc

SEQ ID NO: 16176 - DNA, 20 bp, Artificial Sequence
  Description of Artificial Sequence: Synthetic oligonucleotide
  Target: SOD1; (+) strand; PAM type: YTN; PAM sequence: CTG
gagtgcagtggcgctgtgcg

SEQ ID NO: 16177 - DNA, 20 bp, Artificial Sequence
  Description of Artificial Sequence: Synthetic oligonucleotide
  Target: SOD1; (+) strand; PAM type: YTN; PAM sequence: CTG
tgcgatcatggctgacctta

SEQ ID NO: 16178 - DNA, 20 bp, Artificial Sequence
  Description of Artificial Sequence: Synthetic oligonucleotide
  Target: SOD1; (+) strand; PAM type: YTN; PAM sequence: CTG
accttagccttgacctccca

SEQ ID NO: 16179 - DNA, 20 bp, Artificial Sequence
  Description of Artificial Sequence: Synthetic oligonucleotide
  Target: SOD1; (+) strand; PAM type: YTN; PAM sequence: CTT
agccttgacctcccaggctc

SEQ ID NO: 16180 - DNA, 20 bp, Artificial Sequence
  Description of Artificial Sequence: Synthetic oligonucleotide
  Target: SOD1; (+) strand; PAM type: YTN; PAM sequence: TTA
gccttgacctcccaggctcc

SEQ ID NO: 16181 - DNA, 20 bp, Artificial Sequence
  Description of Artificial Sequence: Synthetic oligonucleotide
  Target: SOD1; (+) strand; PAM type: YTN; PAM sequence: CTT
gacctcccaggctccattga

SEQ ID NO: 16182 - DNA, 20 bp, Artificial Sequence
  Description of Artificial Sequence: Synthetic oligonucleotide
  Target: SOD1; (+) strand; PAM type: YTN; PAM sequence: TTG
acctcccaggctccattgat

SEQ ID NO: 16183 - DNA, 20 bp, Artificial Sequence
  Description of Artificial Sequence: Synthetic oligonucleotide
  Target: SOD1; (+) strand; PAM type: YTN; PAM sequence: CTC
ccaggctccattgatcctca

SEQ ID NO: 16184 - DNA, 20 bp, Artificial Sequence
  Description of Artificial Sequence: Synthetic oligonucleotide
  Target: SOD1; (+) strand; PAM type: YTN; PAM sequence: CTC
cattgatcctcatgccttgg

SEQ ID NO: 16185 - DNA, 20 bp, Artificial Sequence
  Description of Artificial Sequence: Synthetic oligonucleotide
  Target: SOD1; (+) strand; PAM type: YTN; PAM sequence: TTG
atcctcatgccttggcccgt

SEQ ID NO: 16186 - DNA, 20 bp, Artificial Sequence
  Description of Artificial Sequence: Synthetic oligonucleotide
  Target: SOD1; (+) strand; PAM type: YTN; PAM sequence: CTC
atgccttggcccgtagctgg

SEQ ID NO: 16187 - DNA, 20 bp, Artificial Sequence
  Description of Artificial Sequence: Synthetic oligonucleotide
  Target: SOD1; (+) strand; PAM type: YTN; PAM sequence: CTT
ggcccgtagctgggactaca

SEQ ID NO: 16188 - DNA, 20 bp, Artificial Sequence
  Description of Artificial Sequence: Synthetic oligonucleotide
  Target: SOD1; (+) strand; PAM type: YTN; PAM sequence: TTG
gcccgtagctgggactacag

SEQ ID NO: 16189 - DNA, 20 bp, Artificial Sequence
  Description of Artificial Sequence: Synthetic oligonucleotide
  Target: SOD1; (+) strand; PAM type: YTN; PAM sequence: CTG
ggactacaggtacacaccac

SEQ ID NO: 16190 - DNA, 20 bp, Artificial Sequence
  Description of Artificial Sequence: Synthetic oligonucleotide
  Target: SOD1; (+) strand; PAM type: YTN; PAM sequence: CTA
caggtacacaccaccacgcc

SEQ ID NO: 16191 - DNA, 20 bp, Artificial Sequence
  Description of Artificial Sequence: Synthetic oligonucleotide
  Target: SOD1; (+) strand; PAM type: YTN; PAM sequence: CTG
gctaatttttgtattttttt

SEQ ID NO: 16192 - DNA, 20 bp, Artificial Sequence
  Description of Artificial Sequence: Synthetic oligonucleotide
  Target: SOD1; (+) strand; PAM type: YTN; PAM sequence: CTA
atttttgtatttttttctag

SEQ ID NO: 16193 - DNA, 20 bp, Artificial Sequence
  Description of Artificial Sequence: Synthetic oligonucleotide
  Target: SOD1; (+) strand; PAM type: YTN; PAM sequence: TTT
ttgtatttttttctagaggt

SEQ ID NO: 16194 - DNA, 20 bp, Artificial Sequence
  Description of Artificial Sequence: Synthetic oligonucleotide
  Target: SOD1; (+) strand; PAM type: YTN; PAM sequence: TTT
tgtatttttttctagaggtg

SEQ ID NO: 16195 - DNA, 20 bp, Artificial Sequence
  Description of Artificial Sequence: Synthetic oligonucleotide
  Target: SOD1; (+) strand; PAM type: YTN; PAM sequence: TTT
gtatttttttctagaggtgg

SEQ ID NO: 16196 - DNA, 20 bp, Artificial Sequence
  Description of Artificial Sequence: Synthetic oligonucleotide
  Target: SOD1; (+) strand; PAM type: YTN; PAM sequence: TTG
tatttttttctagaggtggg

SEQ ID NO: 16197 - DNA, 20 bp, Artificial Sequence
  Description of Artificial Sequence: Synthetic oligonucleotide
  Target: SOD1; (+) strand; PAM type: YTN; PAM sequence: TTT
ttttctagaggtggggtttc

SEQ ID NO: 16198 - DNA, 20 bp, Artificial Sequence
  Description of Artificial Sequence: Synthetic oligonucleotide
  Target: SOD1; (+) strand; PAM type: YTN; PAM sequence: TTT
tttctagaggtggggtttca

SEQ ID NO: 16199 - DNA, 20 bp, Artificial Sequence
  Description of Artificial Sequence: Synthetic oligonucleotide
  Target: SOD1; (+) strand; PAM type: YTN; PAM sequence: TTT
ttctagaggtggggtttcat

SEQ ID NO: 16200 - DNA, 20 bp, Artificial Sequence
  Description of Artificial Sequence: Synthetic oligonucleotide
  Target: SOD1; (+) strand; PAM type: YTN; PAM sequence: TTT
tctagaggtggggtttcatc

SEQ ID NO: 16201 - DNA, 20 bp, Artificial Sequence
  Description of Artificial Sequence: Synthetic oligonucleotide
  Target: SOD1; (+) strand; PAM type: YTN; PAM sequence: TTT
ctagaggtggggtttcatca

SEQ ID NO: 16202 - DNA, 20 bp, Artificial Sequence
  Description of Artificial Sequence: Synthetic oligonucleotide
  Target: SOD1; (+) strand; PAM type: YTN; PAM sequence: TTC
tagaggtggggtttcatcat

SEQ ID NO: 16203 - DNA, 20 bp, Artificial Sequence
  Description of Artificial Sequence: Synthetic oligonucleotide
  Target: SOD1; (+) strand; PAM type: YTN; PAM sequence: CTA
gaggtggggtttcatcatgt

SEQ ID NO: 16204 - DNA, 20 bp, Artificial Sequence
  Description of Artificial Sequence: Synthetic oligonucleotide
  Target: SOD1; (+) strand; PAM type: YTN; PAM sequence: TTT
catcatgttgcccaggctgg

SEQ ID NO: 16205 - DNA, 20 bp, Artificial Sequence
  Description of Artificial Sequence: Synthetic oligonucleotide
  Target: SOD1; (+) strand; PAM type: YTN; PAM sequence: TTC
atcatgttgcccaggctggt

SEQ ID NO: 16206 - DNA, 20 bp, Artificial Sequence
  Description of Artificial Sequence: Synthetic oligonucleotide
  Target: SOD1; (+) strand; PAM type: YTN; PAM sequence: TTG
cccaggctggtcttgaactg

SEQ ID NO: 16207 - DNA, 20 bp, Artificial Sequence
  Description of Artificial Sequence: Synthetic oligonucleotide
  Target: SOD1; (+) strand; PAM type: YTN; PAM sequence: CTG
gtcttgaactgctgggctca

SEQ ID NO: 16208 - DNA, 20 bp, Artificial Sequence
  Description of Artificial Sequence: Synthetic oligonucleotide
  Target: SOD1; (+) strand; PAM type: YTN; PAM sequence: CTT
gaactgctgggctcaagtgg

SEQ ID NO: 16209 - DNA, 20 bp, Artificial Sequence
  Description of Artificial Sequence: Synthetic oligonucleotide
  Target: SOD1; (+) strand; PAM type: YTN; PAM sequence: TTG
aactgctgggctcaagtggt

SEQ ID NO: 16210 - DNA, 20 bp, Artificial Sequence
  Description of Artificial Sequence: Synthetic oligonucleotide
  Target: SOD1; (+) strand; PAM type: YTN; PAM sequence: CTG
ctgggctcaagtggtctatc

SEQ ID NO: 16211 - DNA, 20 bp, Artificial Sequence
  Description of Artificial Sequence: Synthetic oligonucleotide
  Target: SOD1; (+) strand; PAM type: YTN; PAM sequence: CTG
ggctcaagtggtctatcctc

SEQ ID NO: 16212 - DNA, 20 bp, Artificial Sequence
  Description of Artificial Sequence: Synthetic oligonucleotide
  Target: SOD1; (+) strand; PAM type: YTN; PAM sequence: CTC
aagtggtctatcctcctcga

SEQ ID NO: 16213 - DNA, 20 bp, Artificial Sequence
  Description of Artificial Sequence: Synthetic oligonucleotide
  Target: SOD1; (+) strand; PAM type: YTN; PAM sequence: CTA
tcctcctcgacctcccaaag

SEQ ID NO: 16214 - DNA, 20 bp, Artificial Sequence
  Description of Artificial Sequence: Synthetic oligonucleotide
  Target: SOD1; (+) strand; PAM type: YTN; PAM sequence: CTC
ctcgacctcccaaagtgctg

SEQ ID NO: 16215 - DNA, 20 bp, Artificial Sequence
  Description of Artificial Sequence: Synthetic oligonucleotide
  Target: SOD1; (+) strand; PAM type: YTN; PAM sequence: CTC
gacctcccaaagtgctggga

SEQ ID NO: 16216 - DNA, 20 bp, Artificial Sequence
  Description of Artificial Sequence: Synthetic oligonucleotide
  Target: SOD1; (+) strand; PAM type: YTN; PAM sequence: CTC
ccaaagtgctgggattacat

SEQ ID NO: 16217 - DNA, 20 bp, Artificial Sequence
  Description of Artificial Sequence: Synthetic oligonucleotide
  Target: SOD1; (+) strand; PAM type: YTN; PAM sequence: CTG
ggattacatgtgtgagccac

SEQ ID NO: 16218 - DNA, 20 bp, Artificial Sequence
  Description of Artificial Sequence: Synthetic oligonucleotide
  Target: SOD1; (+) strand; PAM type: YTN; PAM sequence: TTA
catgtgtgagccactgtgcc

SEQ ID NO: 16219 - DNA, 20 bp, Artificial Sequence
  Description of Artificial Sequence: Synthetic oligonucleotide
  Target: SOD1; (+) strand; PAM type: YTN; PAM sequence: CTG
tgcctgggaaaaccctcaac

SEQ ID NO: 16220 - DNA, 20 bp, Artificial Sequence
  Description of Artificial Sequence: Synthetic oligonucleotide
  Target: SOD1; (+) strand; PAM type: YTN; PAM sequence: CTG
ggaaaaccctcaacttttct

SEQ ID NO: 16221 - DNA, 20 bp, Artificial Sequence
  Description of Artificial Sequence: Synthetic oligonucleotide
  Target: SOD1; (+) strand; PAM type: YTN; PAM sequence: CTC
aacttttcttttaaaaaaga

SEQ ID NO: 16222 - DNA, 20 bp, Artificial Sequence
  Description of Artificial Sequence: Synthetic oligonucleotide
  Target: SOD1; (+) strand; PAM type: YTN; PAM sequence: CTT
ttcttttaaaaaagaggtca

SEQ ID NO: 16223 - DNA, 20 bp, Artificial Sequence
  Description of Artificial Sequence: Synthetic oligonucleotide
  Target: SOD1; (+) strand; PAM type: YTN; PAM sequence: TTT
tcttttaaaaaagaggtcaa

SEQ ID NO: 16224 - DNA, 20 bp, Artificial Sequence
  Description of Artificial Sequence: Synthetic oligonucleotide
  Target: SOD1; (+) strand; PAM type: YTN; PAM sequence: TTT
cttttaaaaaagaggtcaac

SEQ ID NO: 16225 - DNA, 20 bp, Artificial Sequence
  Description of Artificial Sequence: Synthetic oligonucleotide
  Target: SOD1; (+) strand; PAM type: YTN; PAM sequence: TTC
ttttaaaaaagaggtcaact

SEQ ID NO: 16226 - DNA, 20 bp, Artificial Sequence
  Description of Artificial Sequence: Synthetic oligonucleotide
  Target: SOD1; (+) strand; PAM type: YTN; PAM sequence: CTT
ttaaaaaagaggtcaacttt

SEQ ID NO: 16227 - DNA, 20 bp, Artificial Sequence
  Description of Artificial Sequence: Synthetic oligonucleotide
  Target: SOD1; (+) strand; PAM type: YTN; PAM sequence: TTT
taaaaaagaggtcaacttta

SEQ ID NO: 16228 - DNA, 20 bp, Artificial Sequence
  Description of Artificial Sequence: Synthetic oligonucleotide
  Target: SOD1; (+) strand; PAM type: YTN; PAM sequence: TTT
aaaaaagaggtcaactttat

SEQ ID NO: 16229 - DNA, 20 bp, Artificial Sequence
  Description of Artificial Sequence: Synthetic oligonucleotide
  Target: SOD1; (+) strand; PAM type: YTN; PAM sequence: TTA
aaaaagaggtcaactttatt

SEQ ID NO: 16230 - DNA, 20 bp, Artificial Sequence
  Description of Artificial Sequence: Synthetic oligonucleotide
  Target: SOD1; (+) strand; PAM type: YTN; PAM sequence: CTT
tattgtatataagcactgtg

SEQ ID NO: 16231 - DNA, 20 bp, Artificial Sequence
  Description of Artificial Sequence: Synthetic oligonucleotide
  Target: SOD1; (+) strand; PAM type: YTN; PAM sequence: TTT
attgtatataagcactgtgc

SEQ ID NO: 16232 - DNA, 20 bp, Artificial Sequence
  Description of Artificial Sequence: Synthetic oligonucleotide
  Target: SOD1; (+) strand; PAM type: YTN; PAM sequence: TTA
ttgtatataagcactgtgct

SEQ ID NO: 16233 - DNA, 20 bp, Artificial Sequence
  Description of Artificial Sequence: Synthetic oligonucleotide
  Target: SOD1; (+) strand; PAM type: YTN; PAM sequence: TTG
tatataagcactgtgctaaa

SEQ ID NO: 16234 - DNA, 20 bp, Artificial Sequence
  Description of Artificial Sequence: Synthetic oligonucleotide
  Target: SOD1; (+) strand; PAM type: YTN; PAM sequence: CTG
tgctaaaattgcaggaactg

SEQ ID NO: 16235 - DNA, 20 bp, Artificial Sequence
  Description of Artificial Sequence: Synthetic oligonucleotide
  Target: SOD1; (+) strand; PAM type: YTN; PAM sequence: CTA
aaattgcaggaactgggacc

SEQ ID NO: 16236 - DNA, 20 bp, Artificial Sequence
  Description of Artificial Sequence: Synthetic oligonucleotide
  Target: SOD1; (+) strand; PAM type: YTN; PAM sequence: TTG
caggaactgggaccatatcc

SEQ ID NO: 16237 - DNA, 20 bp, Artificial Sequence
  Description of Artificial Sequence: Synthetic oligonucleotide
  Target: SOD1; (+) strand; PAM type: YTN; PAM sequence: CTG
ggaccatatcctgatttttg

SEQ ID NO: 16238 - DNA, 20 bp, Artificial Sequence
  Description of Artificial Sequence: Synthetic oligonucleotide
  Target: SOD1; (+) strand; PAM type: YTN; PAM sequence: CTG
atttttgtaataatgccagc

SEQ ID NO: 16239 - DNA, 20 bp, Artificial Sequence
  Description of Artificial Sequence: Synthetic oligonucleotide
  Target: SOD1; (+) strand; PAM type: YTN; PAM sequence: TTT
ttgtaataatgccagcagag

SEQ ID NO: 16240 - DNA, 20 bp, Artificial Sequence
  Description of Artificial Sequence: Synthetic oligonucleotide
  Target: SOD1; (+) strand; PAM type: YTN; PAM sequence: TTT
tgtaataatgccagcagagt

SEQ ID NO: 16241 - DNA, 20 bp, Artificial Sequence
  Description of Artificial Sequence: Synthetic oligonucleotide
  Target: SOD1; (+) strand; PAM type: YTN; PAM sequence: TTT
gtaataatgccagcagagta

SEQ ID NO: 16242 - DNA, 20 bp, Artificial Sequence
  Description of Artificial Sequence: Synthetic oligonucleotide
  Target: SOD1; (+) strand; PAM type: YTN; PAM sequence: TTG
taataatgccagcagagtac

SEQ ID NO: 16243 - DNA, 20 bp, Artificial Sequence
  Description of Artificial Sequence: Synthetic oligonucleotide
  Target: SOD1; (+) strand; PAM type: YTN; PAM sequence: CTG
cactagattgtgaagactgg

SEQ ID NO: 16244 - DNA, 20 bp, Artificial Sequence
  Description of Artificial Sequence: Synthetic oligonucleotide
  Target: SOD1; (+) strand; PAM type: YTN; PAM sequence: CTA
gattgtgaagactggggtgg

SEQ ID NO: 16245 - DNA, 20 bp, Artificial Sequence
  Description of Artificial Sequence: Synthetic oligonucleotide
  Target: SOD1; (+) strand; PAM type: YTN; PAM sequence: TTG
tgaagactggggtggacctg

SEQ ID NO: 16246 - DNA, 20 bp, Artificial Sequence
  Description of Artificial Sequence: Synthetic oligonucleotide
  Target: SOD1; (+) strand; PAM type: YTN; PAM sequence: CTG
gggtggacctgcttctgaag

SEQ ID NO: 16247 - DNA, 20 bp, Artificial Sequence
  Description of Artificial Sequence: Synthetic oligonucleotide
  Target: SOD1; (+) strand; PAM type: YTN; PAM sequence: CTG
cttctgaaggtccagtgccc

SEQ ID NO: 16248 - DNA, 20 bp, Artificial Sequence
  Description of Artificial Sequence: Synthetic oligonucleotide
  Target: SOD1; (+) strand; PAM type: YTN; PAM sequence: CTT
ctgaaggtccagtgcccttt

SEQ ID NO: 16249 - DNA, 20 bp, Artificial Sequence
  Description of Artificial Sequence: Synthetic oligonucleotide
  Target: SOD1; (+) strand; PAM type: YTN; PAM sequence: TTC
tgaaggtccagtgccctttg

SEQ ID NO: 16250 - DNA, 20 bp, Artificial Sequence
  Description of Artificial Sequence: Synthetic oligonucleotide
  Target: SOD1; (+) strand; PAM type: YTN; PAM sequence: CTG
aaggtccagtgccctttgtc

SEQ ID NO: 16251 - DNA, 20 bp, Artificial Sequence
  Description of Artificial Sequence: Synthetic oligonucleotide
  Target: SOD1; (+) strand; PAM type: YTN; PAM sequence: CTT
tgtcttaagatttggtgtag

SEQ ID NO: 16252 - DNA, 20 bp, Artificial Sequence
  Description of Artificial Sequence: Synthetic oligonucleotide
  Target: SOD1; (+) strand; PAM type: YTN; PAM sequence: TTT
gtcttaagatttggtgtagt

SEQ ID NO: 16253 - DNA, 20 bp, Artificial Sequence
  Description of Artificial Sequence: Synthetic oligonucleotide
  Target: SOD1; (+) strand; PAM type: YTN; PAM sequence: TTG
tcttaagatttggtgtagtg

SEQ ID NO: 16254 - DNA, 20 bp, Artificial Sequence
  Description of Artificial Sequence: Synthetic oligonucleotide
  Target: SOD1; (+) strand; PAM type: YTN; PAM sequence: CTT
aagatttggtgtagtgtgtc

SEQ ID NO: 16255 - DNA, 20 bp, Artificial Sequence
  Description of Artificial Sequence: Synthetic oligonucleotide
  Target: SOD1; (+) strand; PAM type: YTN; PAM sequence: TTA
agatttggtgtagtgtgtct

SEQ ID NO: 16256 - DNA, 20 bp, Artificial Sequence
  Description of Artificial Sequence: Synthetic oligonucleotide
  Target: SOD1; (+) strand; PAM type: YTN; PAM sequence: TTT
ggtgtagtgtgtctttagaa

SEQ ID NO: 16257 - DNA, 20 bp, Artificial Sequence
  Description of Artificial Sequence: Synthetic oligonucleotide
  Target: SOD1; (+) strand; PAM type: YTN; PAM sequence: TTG
gtgtagtgtgtctttagaaa

SEQ ID NO: 16258 - DNA, 20 bp, Artificial Sequence
  Description of Artificial Sequence: Synthetic oligonucleotide
  Target: SOD1; (+) strand; PAM type: YTN; PAM sequence: CTT
tagaaaccaaaaaaagagaa

SEQ ID NO: 16259 - DNA, 20 bp, Artificial Sequence
  Description of Artificial Sequence: Synthetic oligonucleotide
  Target: SOD1; (+) strand; PAM type: YTN; PAM sequence: TTT
agaaaccaaaaaaagagaag

SEQ ID NO: 16260 - DNA, 20 bp, Artificial Sequence
  Description of Artificial Sequence: Synthetic oligonucleotide
  Target: SOD1; (+) strand; PAM type: YTN; PAM sequence: TTA
gaaaccaaaaaaagagaaga

SEQ ID NO: 16261 - DNA, 20 bp, Artificial Sequence
  Description of Artificial Sequence: Synthetic oligonucleotide
  Target: SOD1; (+) strand; PAM type: YTN; PAM sequence: CTT
aagattagccacaaaactgg

SEQ ID NO: 16262 - DNA, 20 bp, Artificial Sequence
  Description of Artificial Sequence: Synthetic oligonucleotide
  Target: SOD1; (+) strand; PAM type: YTN; PAM sequence: TTA
agattagccacaaaactggg

SEQ ID NO: 16263 - DNA, 20 bp, Artificial Sequence
  Description of Artificial Sequence: Synthetic oligonucleotide
  Target: SOD1; (+) strand; PAM type: YTN; PAM sequence: TTA
gccacaaaactgggctttga

SEQ ID NO: 16264 - DNA, 20 bp, Artificial Sequence
  Description of Artificial Sequence: Synthetic oligonucleotide
  Target: SOD1; (+) strand; PAM type: YTN; PAM sequence: CTG
ggctttgatacctaggtgtg

SEQ ID NO: 16265 - DNA, 20 bp, Artificial Sequence
  Description of Artificial Sequence: Synthetic oligonucleotide
  Target: SOD1; (+) strand; PAM type: YTN; PAM sequence: CTT
tgatacctaggtgtggaaaa

SEQ ID NO: 16266 - DNA, 20 bp, Artificial Sequence
  Description of Artificial Sequence: Synthetic oligonucleotide
  Target: SOD1; (+) strand; PAM type: YTN; PAM sequence: TTT
gatacctaggtgtggaaaag

SEQ ID NO: 16267 - DNA, 20 bp, Artificial Sequence
  Description of Artificial Sequence: Synthetic oligonucleotide
  Target: SOD1; (+) strand; PAM type: YTN; PAM sequence: TTG
atacctaggtgtggaaaaga

SEQ ID NO: 16268 - DNA, 20 bp, Artificial Sequence
  Description of Artificial Sequence: Synthetic oligonucleotide
  Target: SOD1; (+) strand; PAM type: YTN; PAM sequence: CTA
ggtgtggaaaagaaagggaa

SEQ ID NO: 16269 - DNA, 20 bp, Artificial Sequence
  Description of Artificial Sequence: Synthetic oligonucleotide
  Target: SOD1; (+) strand; PAM type: YTN; PAM sequence: TTG
atgttttgtcttacagcatc

SEQ ID NO: 16270 - DNA, 20 bp, Artificial Sequence
  Description of Artificial Sequence: Synthetic oligonucleotide
  Target: SOD1; (+) strand; PAM type: YTN; PAM sequence: TTT
tgtcttacagcatcattgta

SEQ ID NO: 16271 - DNA, 20 bp, Artificial Sequence
  Description of Artificial Sequence: Synthetic oligonucleotide
  Target: SOD1; (+) strand; PAM type: YTN; PAM sequence: TTT
gtcttacagcatcattgtag

SEQ ID NO: 16272 - DNA, 20 bp, Artificial Sequence
  Description of Artificial Sequence: Synthetic oligonucleotide
  Target: SOD1; (+) strand; PAM type: YTN; PAM sequence: TTG
tcttacagcatcattgtaga

SEQ ID NO: 16273 - DNA, 20 bp, Artificial Sequence
  Description of Artificial Sequence: Synthetic oligonucleotide
  Target: SOD1; (+) strand; PAM type: YTN; PAM sequence: CTT
acagcatcattgtagaagag

SEQ ID NO: 16274 - DNA, 20 bp, Artificial Sequence
  Description of Artificial Sequence: Synthetic oligonucleotide
  Target: SOD1; (+) strand; PAM type: YTN; PAM sequence: TTA
cagcatcattgtagaagagg

SEQ ID NO: 16275 - DNA, 20 bp, Artificial Sequence
  Description of Artificial Sequence: Synthetic oligonucleotide
  Target: SOD1; (+) strand; PAM type: YTN; PAM sequence: TTG
tagaagagggtgtttttttg

SEQ ID NO: 16276 - DNA, 20 bp, Artificial Sequence
  Description of Artificial Sequence: Synthetic oligonucleotide
  Target: SOD1; (+) strand; PAM type: YTN; PAM sequence: TTT
ttttgtttgtttgttttttg

SEQ ID NO: 16277 - DNA, 20 bp, Artificial Sequence
  Description of Artificial Sequence: Synthetic oligonucleotide
  Target: SOD1; (+) strand; PAM type: YTN; PAM sequence: TTT
tttgtttgtttgttttttga

SEQ ID NO: 16278 - DNA, 20 bp, Artificial Sequence
  Description of Artificial Sequence: Synthetic oligonucleotide
  Target: SOD1; (+) strand; PAM type: YTN; PAM sequence: TTT
ttgtttgtttgttttttgag

SEQ ID NO: 16279 - DNA, 20 bp, Artificial Sequence
  Description of Artificial Sequence: Synthetic oligonucleotide
  Target: SOD1; (+) strand; PAM type: YTN; PAM sequence: TTT
tgtttgtttgttttttgaga

SEQ ID NO: 16280 - DNA, 20 bp, Artificial Sequence
  Description of Artificial Sequence: Synthetic oligonucleotide
  Target: SOD1; (+) strand; PAM type: YTN; PAM sequence: TTT
gtttgtttgttttttgagac

SEQ ID NO: 16281 - DNA, 20 bp, Artificial Sequence
  Description of Artificial Sequence: Synthetic oligonucleotide
  Target: SOD1; (+) strand; PAM type: YTN; PAM sequence: TTG
tttgtttgttttttgagacg

SEQ ID NO: 16282 - DNA, 20 bp, Artificial Sequence
  Description of Artificial Sequence: Synthetic oligonucleotide
  Target: SOD1; (+) strand; PAM type: YTN; PAM sequence: TTT
gtttgttttttgagacggag

SEQ ID NO: 16283 - DNA, 20 bp, Artificial Sequence
  Description of Artificial Sequence: Synthetic oligonucleotide
  Target: SOD1; (+) strand; PAM type: YTN; PAM sequence: TTG
tttgttttttgagacggagt

SEQ ID NO: 16284 - DNA, 20 bp, Artificial Sequence
  Description of Artificial Sequence: Synthetic oligonucleotide
  Target: SOD1; (+) strand; PAM type: YTN; PAM sequence: TTT
gttttttgagacggagtctt

SEQ ID NO: 16285 - DNA, 20 bp, Artificial Sequence
  Description of Artificial Sequence: Synthetic oligonucleotide
  Target: SOD1; (+) strand; PAM type: YTN; PAM sequence: TTG
ttttttgagacggagtctta

SEQ ID NO: 16286 - DNA, 20 bp, Artificial Sequence
  Description of Artificial Sequence: Synthetic oligonucleotide
  Target: SOD1; (+) strand; PAM type: YTN; PAM sequence: TTT
tttgagacggagtcttactc

SEQ ID NO: 16287 - DNA, 20 bp, Artificial Sequence
  Description of Artificial Sequence: Synthetic oligonucleotide
  Target: SOD1; (+) strand; PAM type: YTN; PAM sequence: TTT
ttgagacggagtcttactct

SEQ ID NO: 16288 - DNA, 20 bp, Artificial Sequence
  Description of Artificial Sequence: Synthetic oligonucleotide
  Target: SOD1; (+) strand; PAM type: YTN; PAM sequence: TTT
tgagacggagtcttactctg

SEQ ID NO: 16289 - DNA, 20 bp, Artificial Sequence
  Description of Artificial Sequence: Synthetic oligonucleotide
  Target: SOD1; (+) strand; PAM type: YTN; PAM sequence: TTT
gagacggagtcttactctgt

SEQ ID NO: 16290 - DNA, 20 bp, Artificial Sequence
  Description of Artificial Sequence: Synthetic oligonucleotide
  Target: SOD1; (+) strand; PAM type: YTN; PAM sequence: TTG
agacggagtcttactctgtg

SEQ ID NO: 16291 - DNA, 20 bp, Artificial Sequence
  Description of Artificial Sequence: Synthetic oligonucleotide
  Target: SOD1; (+) strand; PAM type: YTN; PAM sequence: CTT
actctgtggcccaggctgga

SEQ ID NO: 16292 - DNA, 20 bp, Artificial Sequence
  Description of Artificial Sequence: Synthetic oligonucleotide
  Target: SOD1; (+) strand; PAM type: YTN; PAM sequence: TTA
ctctgtggcccaggctggag

SEQ ID NO: 16293 - DNA, 20 bp, Artificial Sequence
  Description of Artificial Sequence: Synthetic oligonucleotide
  Target: SOD1; (+) strand; PAM type: YTN; PAM sequence: CTC
tgtggcccaggctggagtgc

SEQ ID NO: 16294 - DNA, 20 bp, Artificial Sequence
  Description of Artificial Sequence: Synthetic oligonucleotide
  Target: SOD1; (+) strand; PAM type: YTN; PAM sequence: CTG
tggcccaggctggagtgcag

SEQ ID NO: 16295 - DNA, 20 bp, Artificial Sequence
  Description of Artificial Sequence: Synthetic oligonucleotide
  Target: SOD1; (+) strand; PAM type: YTN; PAM sequence: CTG
gagtgcagtggcgcgatctc

SEQ ID NO: 16296 - DNA, 20 bp, Artificial Sequence
  Description of Artificial Sequence: Synthetic oligonucleotide
  Target: SOD1; (+) strand; PAM type: YTN; PAM sequence: CTC
ggctcactgcaagctccgcc

SEQ ID NO: 16297 - DNA, 20 bp, Artificial Sequence
  Description of Artificial Sequence: Synthetic oligonucleotide
  Target: SOD1; (+) strand; PAM type: YTN; PAM sequence: CTC
actgcaagctccgcctcccg

SEQ ID NO: 16298 - DNA, 20 bp, Artificial Sequence
  Description of Artificial Sequence: Synthetic oligonucleotide
  Target: SOD1; (+) strand; PAM type: YTN; PAM sequence: CTG
caagctccgcctcccgggtt

SEQ ID NO: 16299 - DNA, 20 bp, Artificial Sequence
  Description of Artificial Sequence: Synthetic oligonucleotide
  Target: SOD1; (+) strand; PAM type: YTN; PAM sequence: CTC
cgcctcccgggttcatgcca

SEQ ID NO: 16300 - DNA, 20 bp, Artificial Sequence
  Description of Artificial Sequence: Synthetic oligonucleotide
  Target: SOD1; (+) strand; PAM type: YTN; PAM sequence: CTC
ccgggttcatgccattctcc

SEQ ID NO: 16301 - DNA, 20 bp, Artificial Sequence
  Description of Artificial Sequence: Synthetic oligonucleotide
  Target: SOD1; (+) strand; PAM type: YTN; PAM sequence: TTC
atgccattctcctgcctcag

SEQ ID NO: 16302 - DNA, 20 bp, Artificial Sequence
  Description of Artificial Sequence: Synthetic oligonucleotide
  Target: SOD1; (+) strand; PAM type: YTN; PAM sequence: TTC
tcctgcctcagccccctgag

SEQ ID NO: 16303 - DNA, 20 bp, Artificial Sequence
  Description of Artificial Sequence: Synthetic oligonucleotide
  Target: SOD1; (+) strand; PAM type: YTN; PAM sequence: CTC
ctgcctcagccccctgagta

SEQ ID NO: 16304 - DNA, 20 bp, Artificial Sequence
  Description of Artificial Sequence: Synthetic oligonucleotide
  Target: SOD1; (+) strand; PAM type: YTN; PAM sequence: CTG
cctcagccccctgagtagct

SEQ ID NO: 16305 - DNA, 20 bp, Artificial Sequence
  Description of Artificial Sequence: Synthetic oligonucleotide
  Target: SOD1; (+) strand; PAM type: YTN; PAM sequence: CTC
agccccctgagtagctggga

SEQ ID NO: 16306 - DNA, 20 bp, Artificial Sequence
  Description of Artificial Sequence: Synthetic oligonucleotide
  Target: SOD1; (+) strand; PAM type: YTN; PAM sequence: CTG
agtagctgggactacaggtg

SEQ ID NO: 16307 - DNA, 20 bp, Artificial Sequence
  Description of Artificial Sequence: Synthetic oligonucleotide
  Target: SOD1; (+) strand; PAM type: YTN; PAM sequence: CTG
ggactacaggtgcccgccac

SEQ ID NO: 16308 - DNA, 20 bp, Artificial Sequence
  Description of Artificial Sequence: Synthetic oligonucleotide
  Target: SOD1; (+) strand; PAM type: YTN; PAM sequence: CTA
caggtgcccgccaccccgcc

SEQ ID NO: 16309 - DNA, 20 bp, Artificial Sequence
  Description of Artificial Sequence: Synthetic oligonucleotide
  Target: SOD1; (+) strand; PAM type: YTN; PAM sequence: CTG
gctaattttttgtattttta

SEQ ID NO: 16310 - DNA, 20 bp, Artificial Sequence
  Description of Artificial Sequence: Synthetic oligonucleotide
  Target: SOD1; (+) strand; PAM type: YTN; PAM sequence: CTA
attttttgtatttttagtag

SEQ ID NO: 16311 - DNA, 20 bp, Artificial Sequence
  Description of Artificial Sequence: Synthetic oligonucleotide
  Target: SOD1; (+) strand; PAM type: YTN; PAM sequence: TTT
tttgtatttttagtagagac

SEQ ID NO: 16312 - DNA, 20 bp, Artificial Sequence
  Description of Artificial Sequence: Synthetic oligonucleotide
  Target: SOD1; (+) strand; PAM type: YTN; PAM sequence: TTT
ttgtatttttagtagagacg

SEQ ID NO: 16313 - DNA, 20 bp, Artificial Sequence
  Description of Artificial Sequence: Synthetic oligonucleotide
  Target: SOD1; (+) strand; PAM type: YTN; PAM sequence: TTT
tgtatttttagtagagacgg

SEQ ID NO: 16314 - DNA, 20 bp, Artificial Sequence
  Description of Artificial Sequence: Synthetic oligonucleotide
  Target: SOD1; (+) strand; PAM type: YTN; PAM sequence: TTT
gtatttttagtagagacggg

SEQ ID NO: 16315 - DNA, 20 bp, Artificial Sequence
  Description of Artificial Sequence: Synthetic oligonucleotide
  Target: SOD1; (+) strand; PAM type: YTN; PAM sequence: TTG
tatttttagtagagacgggg

SEQ ID NO: 16316 - DNA, 20 bp, Artificial Sequence
  Description of Artificial Sequence: Synthetic oligonucleotide
  Target: SOD1; (+) strand; PAM type: YTN; PAM sequence: TTT
ttagtagagacggggtttca

SEQ ID NO: 16317 - DNA, 20 bp, Artificial Sequence
  Description of Artificial Sequence: Synthetic oligonucleotide
  Target: SOD1; (+) strand; PAM type: YTN; PAM sequence: TTT
tagtagagacggggtttcac

SEQ ID NO: 16318 - DNA, 20 bp, Artificial Sequence
  Description of Artificial Sequence: Synthetic oligonucleotide
  Target: SOD1; (+) strand; PAM type: YTN; PAM sequence: TTT
agtagagacggggtttcact

SEQ ID NO: 16319 - DNA, 20 bp, Artificial Sequence
  Description of Artificial Sequence: Synthetic oligonucleotide
  Target: SOD1; (+) strand; PAM type: YTN; PAM sequence: TTA
gtagagacggggtttcactg

SEQ ID NO: 16320 - DNA, 20 bp, Artificial Sequence
  Description of Artificial Sequence: Synthetic oligonucleotide
  Target: SOD1; (+) strand; PAM type: YTN; PAM sequence: TTT
cactgtgttagccaagatgg

SEQ ID NO: 16321 - DNA, 20 bp, Artificial Sequence
  Description of Artificial Sequence: Synthetic oligonucleotide
  Target: SOD1; (+) strand; PAM type: YTN; PAM sequence: TTC
actgtgttagccaagatggt

SEQ ID NO: 16322 - DNA, 20 bp, Artificial Sequence
  Description of Artificial Sequence: Synthetic oligonucleotide
  Target: SOD1; (+) strand; PAM type: YTN; PAM sequence: CTG
tgttagccaagatggtctct

SEQ ID NO: 16323 - DNA, 20 bp, Artificial Sequence
  Description of Artificial Sequence: Synthetic oligonucleotide
  Target: SOD1; (+) strand; PAM type: YTN; PAM sequence: TTA
gccaagatggtctctctcct

SEQ ID NO: 16324 - DNA, 20 bp, Artificial Sequence
  Description of Artificial Sequence: Synthetic oligonucleotide
  Target: SOD1; (+) strand; PAM type: YTN; PAM sequence: CTC
tctcctgacctcgtgatccg

SEQ ID NO: 16325 - DNA, 20 bp, Artificial Sequence
  Description of Artificial Sequence: Synthetic oligonucleotide
  Target: SOD1; (+) strand; PAM type: YTN; PAM sequence: CTC
tcctgacctcgtgatccgcc

SEQ ID NO: 16326 - DNA, 20 bp, Artificial Sequence
  Description of Artificial Sequence: Synthetic oligonucleotide
  Target: SOD1; (+) strand; PAM type: YTN; PAM sequence: CTC
ctgacctcgtgatccgcctg

SEQ ID NO: 16327 - DNA, 20 bp, Artificial Sequence
  Description of Artificial Sequence: Synthetic oligonucleotide
  Target: SOD1; (+) strand; PAM type: YTN; PAM sequence: CTG
acctcgtgatccgcctgtct

SEQ ID NO: 16328 - DNA, 20 bp, Artificial Sequence
  Description of Artificial Sequence: Synthetic oligonucleotide
  Target: SOD1; (+) strand; PAM type: YTN; PAM sequence: CTC
gtgatccgcctgtctcagcc

SEQ ID NO: 16329 - DNA, 20 bp, Artificial Sequence
  Description of Artificial Sequence: Synthetic oligonucleotide
  Target: SOD1; (+) strand; PAM type: YTN; PAM sequence: CTG
tctcagcctcccaaagtgct

SEQ ID NO: 16330 - DNA, 20 bp, Artificial Sequence
  Description of Artificial Sequence: Synthetic oligonucleotide
  Target: SOD1; (+) strand; PAM type: YTN; PAM sequence: CTC
agcctcccaaagtgctggga

SEQ ID NO: 16331 - DNA, 20 bp, Artificial Sequence
  Description of Artificial Sequence: Synthetic oligonucleotide
  Target: SOD1; (+) strand; PAM type: YTN; PAM sequence: CTC
ccaaagtgctgggattacag

SEQ ID NO: 16332 - DNA, 20 bp, Artificial Sequence
  Description of Artificial Sequence: Synthetic oligonucleotide
  Target: SOD1; (+) strand; PAM type: YTN; PAM sequence: CTG
ggattacaggcatgagccac

SEQ ID NO: 16333 - DNA, 20 bp, Artificial Sequence
  Description of Artificial Sequence: Synthetic oligonucleotide
  Target: SOD1; (+) strand; PAM type: YTN; PAM sequence: TTA
caggcatgagccaccgcacc

SEQ ID NO: 16334 - DNA, 20 bp, Artificial Sequence
  Description of Artificial Sequence: Synthetic oligonucleotide
  Target: SOD1; (+) strand; PAM type: YTN; PAM sequence: TTT
tttaaagaaggcaaatagga

SEQ ID NO: 16335 - DNA, 20 bp, Artificial Sequence
  Description of Artificial Sequence: Synthetic oligonucleotide
  Target: SOD1; (+) strand; PAM type: YTN; PAM sequence: TTT
ttaaagaaggcaaataggaa

SEQ ID NO: 16336 - DNA, 20 bp, Artificial Sequence
  Description of Artificial Sequence: Synthetic oligonucleotide
  Target: SOD1; (+) strand; PAM type: YTN; PAM sequence: TTT
taaagaaggcaaataggaaa

SEQ ID NO: 16337 - DNA, 20 bp, Artificial Sequence
  Description of Artificial Sequence: Synthetic oligonucleotide
  Target: SOD1; (+) strand; PAM type: YTN; PAM sequence: TTT
aaagaaggcaaataggaaat

SEQ ID NO: 16338 - DNA, 20 bp, Artificial Sequence
  Description of Artificial Sequence: Synthetic oligonucleotide
  Target: SOD1; (+) strand; PAM type: YTN; PAM sequence: TTA
aagaaggcaaataggaaata

SEQ ID NO: 16339 - DNA, 20 bp, Artificial Sequence
  Description of Artificial Sequence: Synthetic oligonucleotide
  Target: SOD1; (+) strand; PAM type: YTN; PAM sequence: CTT
gggctcttaacttttgtaat

SEQ ID NO: 16340 - DNA, 20 bp, Artificial Sequence
  Description of Artificial Sequence: Synthetic oligonucleotide
  Target: SOD1; (+) strand; PAM type: YTN; PAM sequence: TTG
ggctcttaacttttgtaatg

SEQ ID NO: 16341 - DNA, 20 bp, Artificial Sequence
  Description of Artificial Sequence: Synthetic oligonucleotide
  Target: SOD1; (+) strand; PAM type: YTN; PAM sequence: CTC
ttaacttttgtaatgatccc

SEQ ID NO: 16342 - DNA, 20 bp, Artificial Sequence
  Description of Artificial Sequence: Synthetic oligonucleotide
  Target: SOD1; (+) strand; PAM type: YTN; PAM sequence: CTT
aacttttgtaatgatcccag

SEQ ID NO: 16343 - DNA, 20 bp, Artificial Sequence
  Description of Artificial Sequence: Synthetic oligonucleotide
  Target: SOD1; (+) strand; PAM type: YTN; PAM sequence: TTA
acttttgtaatgatcccagg

SEQ ID NO: 16344 - DNA, 20 bp, Artificial Sequence
  Description of Artificial Sequence: Synthetic oligonucleotide
  Target: SOD1; (+) strand; PAM type: YTN; PAM sequence: CTT
ttgtaatgatcccaggtgtt

SEQ ID NO: 16345 - DNA, 20 bp, Artificial Sequence
  Description of Artificial Sequence: Synthetic oligonucleotide
  Target: SOD1; (+) strand; PAM type: YTN; PAM sequence: TTT
tgtaatgatcccaggtgttt

SEQ ID NO: 16346 - DNA, 20 bp, Artificial Sequence
  Description of Artificial Sequence: Synthetic oligonucleotide
  Target: SOD1; (+) strand; PAM type: YTN; PAM sequence: TTT
gtaatgatcccaggtgtttg

SEQ ID NO: 16347 - DNA, 20 bp, Artificial Sequence
  Description of Artificial Sequence: Synthetic oligonucleotide
  Target: SOD1; (+) strand; PAM type: YTN; PAM sequence: TTG
taatgatcccaggtgtttga

SEQ ID NO: 16348 - DNA, 20 bp, Artificial Sequence
  Description of Artificial Sequence: Synthetic oligonucleotide
  Target: SOD1; (+) strand; PAM type: YTN; PAM sequence: TTT
gagctgggggttgagggtgg

SEQ ID NO: 16349 - DNA, 20 bp, Artificial Sequence
  Description of Artificial Sequence: Synthetic oligonucleotide
  Target: SOD1; (+) strand; PAM type: YTN; PAM sequence: TTG
agctgggggttgagggtggg

SEQ ID NO: 16350 - DNA, 20 bp, Artificial Sequence
  Description of Artificial Sequence: Synthetic oligonucleotide
  Target: SOD1; (+) strand; PAM type: YTN; PAM sequence: CTG
ggggttgagggtgggtgcct

SEQ ID NO: 16351 - DNA, 20 bp, Artificial Sequence
  Description of Artificial Sequence: Synthetic oligonucleotide
  Target: SOD1; (+) strand; PAM type: YTN; PAM sequence: TTG
agggtgggtgcctcgagcaa

SEQ ID NO: 16352 - DNA, 20 bp, Artificial Sequence
  Description of Artificial Sequence: Synthetic oligonucleotide
  Target: SOD1; (+) strand; PAM type: YTN; PAM sequence: CTC
gagcaaaggggctgcattta

SEQ ID NO: 16353 - DNA, 20 bp, Artificial Sequence
  Description of Artificial Sequence: Synthetic oligonucleotide
  Target: SOD1; (+) strand; PAM type: YTN; PAM sequence: CTG
catttatttgcataatgcca

SEQ ID NO: 16354 - DNA, 20 bp, Artificial Sequence
  Description of Artificial Sequence: Synthetic oligonucleotide
  Target: SOD1; (+) strand; PAM type: YTN; PAM sequence: TTT
atttgcataatgccatgtaa

SEQ ID NO: 16355 - DNA, 20 bp, Artificial Sequence
  Description of Artificial Sequence: Synthetic oligonucleotide
  Target: SOD1; (+) strand; PAM type: YTN; PAM sequence: TTA
tttgcataatgccatgtaag

SEQ ID NO: 16356 - DNA, 20 bp, Artificial Sequence
  Description of Artificial Sequence: Synthetic oligonucleotide
  Target: SOD1; (+) strand; PAM type: YTN; PAM sequence: TTT
gcataatgccatgtaagagt

SEQ ID NO: 16357 - DNA, 20 bp, Artificial Sequence
  Description of Artificial Sequence: Synthetic oligonucleotide
  Target: SOD1; (+) strand; PAM type: YTN; PAM sequence: TTG
cataatgccatgtaagagta

SEQ ID NO: 16358 - DNA, 20 bp, Artificial Sequence
  Description of Artificial Sequence: Synthetic oligonucleotide
  Target: SOD1; (+) strand; PAM type: YTN; PAM sequence: CTC
tacaccccaaacacaggctt

SEQ ID NO: 16359 - DNA, 20 bp, Artificial Sequence
  Description of Artificial Sequence: Synthetic oligonucleotide
  Target: SOD1; (+) strand; PAM type: YTN; PAM sequence: CTA
caccccaaacacaggcttct

SEQ ID NO: 16360 - DNA, 20 bp, Artificial Sequence
  Description of Artificial Sequence: Synthetic oligonucleotide
  Target: SOD1; (+) strand; PAM type: YTN; PAM sequence: CTT
cttagtgggaccaaagtatg

SEQ ID NO: 16361 - DNA, 20 bp, Artificial Sequence
  Description of Artificial Sequence: Synthetic oligonucleotide
  Target: SOD1; (+) strand; PAM type: YTN; PAM sequence: TTC
ttagtgggaccaaagtatga

SEQ ID NO: 16362 - DNA, 20 bp, Artificial Sequence
  Description of Artificial Sequence: Synthetic oligonucleotide
  Target: SOD1; (+) strand; PAM type: YTN; PAM sequence: CTT
agtgggaccaaagtatgata

SEQ ID NO: 16363 - DNA, 20 bp, Artificial Sequence
  Description of Artificial Sequence: Synthetic oligonucleotide
  Target: SOD1; (+) strand; PAM type: YTN; PAM sequence: TTA
gtgggaccaaagtatgatac

SEQ ID NO: 16364 - DNA, 20 bp, Artificial Sequence
  Description of Artificial Sequence: Synthetic oligonucleotide
  Target: SOD1; (+) strand; PAM type: YTN; PAM sequence: CTG
aagatggaatgcagaggatt

SEQ ID NO: 16365 - DNA, 20 bp, Artificial Sequence
  Description of Artificial Sequence: Synthetic oligonucleotide
  Target: SOD1; (+) strand; PAM type: YTN; PAM sequence: TTA
ttggtactttggaatatgct

SEQ ID NO: 16366 - DNA, 20 bp, Artificial Sequence
  Description of Artificial Sequence: Synthetic oligonucleotide
  Target: SOD1; (+) strand; PAM type: YTN; PAM sequence: TTG
gtactttggaatatgcttaa

SEQ ID NO: 16367 - DNA, 20 bp, Artificial Sequence
  Description of Artificial Sequence: Synthetic oligonucleotide
  Target: SOD1; (+) strand; PAM type: YTN; PAM sequence: CTT
tggaatatgcttaaaaaaaa

SEQ ID NO: 16368 - DNA, 20 bp, Artificial Sequence
  Description of Artificial Sequence: Synthetic oligonucleotide
  Target: SOD1; (+) strand; PAM type: YTN; PAM sequence: TTT
ggaatatgcttaaaaaaaat

SEQ ID NO: 16369 - DNA, 20 bp, Artificial Sequence
  Description of Artificial Sequence: Synthetic oligonucleotide
  Target: SOD1; (+) strand; PAM type: YTN; PAM sequence: TTG
gaatatgcttaaaaaaaatt

SEQ ID NO: 16370 - DNA, 20 bp, Artificial Sequence
  Description of Artificial Sequence: Synthetic oligonucleotide
  Target: SOD1; (+) strand; PAM type: YTN; PAM sequence: CTT
aaaaaaaatttttttaaagt

SEQ ID NO: 16371 - DNA, 20 bp, Artificial Sequence
  Description of Artificial Sequence: Synthetic oligonucleotide
  Target: SOD1; (+) strand; PAM type: YTN; PAM sequence: TTA
aaaaaaatttttttaaagta

SEQ ID NO: 16372 - DNA, 20 bp, Artificial Sequence
  Description of Artificial Sequence: Synthetic oligonucleotide
  Target: SOD1; (+) strand; PAM type: YTN; PAM sequence: TTT
ttttaaagtatttttaaaaa

SEQ ID NO: 16373 - DNA, 20 bp, Artificial Sequence
  Description of Artificial Sequence: Synthetic oligonucleotide
  Target: SOD1; (+) strand; PAM type: YTN; PAM sequence: TTT
tttaaagtatttttaaaaaa

SEQ ID NO: 16374 - DNA, 20 bp, Artificial Sequence
  Description of Artificial Sequence: Synthetic oligonucleotide
  Target: SOD1; (+) strand; PAM type: YTN; PAM sequence: TTT
ttaaagtatttttaaaaaat

SEQ ID NO: 16375 - DNA, 20 bp, Artificial Sequence
  Description of Artificial Sequence: Synthetic oligonucleotide
  Target: SOD1; (+) strand; PAM type: YTN; PAM sequence: TTT
taaagtatttttaaaaaatc

SEQ ID NO: 16376 - DNA, 20 bp, Artificial Sequence
  Description of Artificial Sequence: Synthetic oligonucleotide
  Target: SOD1; (+) strand; PAM type: YTN; PAM sequence: TTT
aaagtatttttaaaaaatca

SEQ ID NO: 16377 - DNA, 20 bp, Artificial Sequence
  Description of Artificial Sequence: Synthetic oligonucleotide
  Target: SOD1; (+) strand; PAM type: YTN; PAM sequence: TTA
aagtatttttaaaaaatcag

SEQ ID NO: 16378 - DNA, 20 bp, Artificial Sequence
  Description of Artificial Sequence: Synthetic oligonucleotide
  Target: SOD1; (+) strand; PAM type: YTN; PAM sequence: TTT
ttaaaaaatcaggcaacccc

SEQ ID NO: 16379 - DNA, 20 bp, Artificial Sequence
  Description of Artificial Sequence: Synthetic oligonucleotide
  Target: SOD1; (+) strand; PAM type: YTN; PAM sequence: TTT
taaaaaatcaggcaacccct

SEQ ID NO: 16380 - DNA, 20 bp, Artificial Sequence
  Description of Artificial Sequence: Synthetic oligonucleotide
  Target: SOD1; (+) strand; PAM type: YTN; PAM sequence: TTT
aaaaaatcaggcaacccctg

SEQ ID NO: 16381 - DNA, 20 bp, Artificial Sequence
  Description of Artificial Sequence: Synthetic oligonucleotide
  Target: SOD1; (+) strand; PAM type: YTN; PAM sequence: TTA
aaaaatcaggcaacccctga

SEQ ID NO: 16382 - DNA, 20 bp, Artificial Sequence
  Description of Artificial Sequence: Synthetic oligonucleotide
  Target: SOD1; (+) strand; PAM type: YTN; PAM sequence: CTG
aaccagagtaggttcagaga

SEQ ID NO: 16383 - DNA, 20 bp, Artificial Sequence
  Description of Artificial Sequence: Synthetic oligonucleotide
  Target: SOD1; (+) strand; PAM type: YTN; PAM sequence: TTC
agagaaactgccaaatttta

SEQ ID NO: 16384 - DNA, 20 bp, Artificial Sequence
  Description of Artificial Sequence: Synthetic oligonucleotide
  Target: SOD1; (+) strand; PAM type: YTN; PAM sequence: CTG
ccaaattttattttcttaat

SEQ ID NO: 16385 - DNA, 20 bp, Artificial Sequence
  Description of Artificial Sequence: Synthetic oligonucleotide
  Target: SOD1; (+) strand; PAM type: YTN; PAM sequence: TTT
tattttcttaatttgggatt

SEQ ID NO: 16386 - DNA, 20 bp, Artificial Sequence
  Description of Artificial Sequence: Synthetic oligonucleotide
  Target: SOD1; (+) strand; PAM type: YTN; PAM sequence: TTT
attttcttaatttgggattg

SEQ ID NO: 16387 - DNA, 20 bp, Artificial Sequence
  Description of Artificial Sequence: Synthetic oligonucleotide
  Target: SOD1; (+) strand; PAM type: YTN; PAM sequence: TTA
ttttcttaatttgggattgg

SEQ ID NO: 16388 - DNA, 20 bp, Artificial Sequence
  Description of Artificial Sequence: Synthetic oligonucleotide
  Target: SOD1; (+) strand; PAM type: YTN; PAM sequence: TTT
tcttaatttgggattggaag

SEQ ID NO: 16389 - DNA, 20 bp, Artificial Sequence
  Description of Artificial Sequence: Synthetic oligonucleotide
  Target: SOD1; (+) strand; PAM type: YTN; PAM sequence: TTT
cttaatttgggattggaagc

SEQ ID NO: 16390 - DNA, 20 bp, Artificial Sequence
  Description of Artificial Sequence: Synthetic oligonucleotide
  Target: SOD1; (+) strand; PAM type: YTN; PAM sequence: TTC
ttaatttgggattggaagca

SEQ ID NO: 16391 - DNA, 20 bp, Artificial Sequence
  Description of Artificial Sequence: Synthetic oligonucleotide
  Target: SOD1; (+) strand; PAM type: YTN; PAM sequence: CTT
aatttgggattggaagcaag

SEQ ID NO: 16392 - DNA, 20 bp, Artificial Sequence
  Description of Artificial Sequence: Synthetic oligonucleotide
  Target: SOD1; (+) strand; PAM type: YTN; PAM sequence: TTA
atttgggattggaagcaagt

SEQ ID NO: 16393 - DNA, 20 bp, Artificial Sequence
  Description of Artificial Sequence: Synthetic oligonucleotide
  Target: SOD1; (+) strand; PAM type: YTN; PAM sequence: TTT
gggattggaagcaagttaac

SEQ ID NO: 16394 - DNA, 20 bp, Artificial Sequence
  Description of Artificial Sequence: Synthetic oligonucleotide
  Target: SOD1; (+) strand; PAM type: YTN; PAM sequence: TTG
ggattggaagcaagttaaca

SEQ ID NO: 16395 - DNA, 20 bp, Artificial Sequence
  Description of Artificial Sequence: Synthetic oligonucleotide
  Target: SOD1; (+) strand; PAM type: YTN; PAM sequence: TTG
gaagcaagttaacagaagtt

SEQ ID NO: 16396 - DNA, 20 bp, Artificial Sequence
  Description of Artificial Sequence: Synthetic oligonucleotide
  Target: SOD1; (+) strand; PAM type: YTN; PAM sequence: TTA
acagaagtttatgagttaag

SEQ ID NO: 16397 - DNA, 20 bp, Artificial Sequence
  Description of Artificial Sequence: Synthetic oligonucleotide
  Target: SOD1; (+) strand; PAM type: YTN; PAM sequence: TTT
atgagttaagttgcatttag

SEQ ID NO: 16398 - DNA, 20 bp, Artificial Sequence
  Description of Artificial Sequence: Synthetic oligonucleotide
  Target: SOD1; (+) strand; PAM type: YTN; PAM sequence: TTA
tgagttaagttgcatttagt

SEQ ID NO: 16399 - DNA, 20 bp, Artificial Sequence
  Description of Artificial Sequence: Synthetic oligonucleotide
  Target: SOD1; (+) strand; PAM type: YTN; PAM sequence: TTA
agttgcatttagtgatcttt

SEQ ID NO: 16400 - DNA, 20 bp, Artificial Sequence
  Description of Artificial Sequence: Synthetic oligonucleotide
  Target: SOD1; (+) strand; PAM type: YTN; PAM sequence: TTG
catttagtgatcttttgcca

SEQ ID NO: 16401 - DNA, 20 bp, Artificial Sequence
  Description of Artificial Sequence: Synthetic oligonucleotide
  Target: SOD1; (+) strand; PAM type: YTN; PAM sequence: TTT
agtgatcttttgccatattt

SEQ ID NO: 16402 - DNA, 20 bp, Artificial Sequence
  Description of Artificial Sequence: Synthetic oligonucleotide
  Target: SOD1; (+) strand; PAM type: YTN; PAM sequence: TTA
gtgatcttttgccatatttg

SEQ ID NO: 16403 - DNA, 20 bp, Artificial Sequence
  Description of Artificial Sequence: Synthetic oligonucleotide
  Target: SOD1; (+) strand; PAM type: YTN; PAM sequence: CTT
ttgccatatttgagtaataa

SEQ ID NO: 16404 - DNA, 20 bp, Artificial Sequence
  Description of Artificial Sequence: Synthetic oligonucleotide
  Target: SOD1; (+) strand; PAM type: YTN; PAM sequence: TTT
tgccatatttgagtaataat

SEQ ID NO: 16405 - DNA, 20 bp, Artificial Sequence
  Description of Artificial Sequence: Synthetic oligonucleotide
  Target: SOD1; (+) strand; PAM type: YTN; PAM sequence: TTT
gccatatttgagtaataatc

SEQ ID NO: 16406 - DNA, 20 bp, Artificial Sequence
  Description of Artificial Sequence: Synthetic oligonucleotide
  Target: SOD1; (+) strand; PAM type: YTN; PAM sequence: TTG
ccatatttgagtaataatct

SEQ ID NO: 16407 - DNA, 20 bp, Artificial Sequence
  Description of Artificial Sequence: Synthetic oligonucleotide
  Target: SOD1; (+) strand; PAM type: YTN; PAM sequence: TTT
gagtaataatctgatttttt

SEQ ID NO: 16408 - DNA, 20 bp, Artificial Sequence
  Description of Artificial Sequence: Synthetic oligonucleotide
  Target: SOD1; (+) strand; PAM type: YTN; PAM sequence: TTG
agtaataatctgattttttt

SEQ ID NO: 16409 - DNA, 20 bp, Artificial Sequence
  Description of Artificial Sequence: Synthetic oligonucleotide
  Target: SOD1; (+) strand; PAM type: YTN; PAM sequence: CTG
atttttttgtttatagattt

SEQ ID NO: 16410 - DNA, 20 bp, Artificial Sequence
  Description of Artificial Sequence: Synthetic oligonucleotide
  Target: SOD1; (+) strand; PAM type: YTN; PAM sequence: TTT
ttttgtttatagatttcttc

SEQ ID NO: 16411 - DNA, 20 bp, Artificial Sequence
  Description of Artificial Sequence: Synthetic oligonucleotide
  Target: SOD1; (+) strand; PAM type: YTN; PAM sequence: TTT
tttgtttatagatttcttct

SEQ ID NO: 16412 - DNA, 20 bp, Artificial Sequence
  Description of Artificial Sequence: Synthetic oligonucleotide
  Target: SOD1; (+) strand; PAM type: YTN; PAM sequence: TTT
ttgtttatagatttcttctt

SEQ ID NO: 16413 - DNA, 20 bp, Artificial Sequence
  Description of Artificial Sequence: Synthetic oligonucleotide
  Target: SOD1; (+) strand; PAM type: YTN; PAM sequence: TTT
tgtttatagatttcttctta

SEQ ID NO: 16414 - DNA, 20 bp, Artificial Sequence
  Description of Artificial Sequence: Synthetic oligonucleotide
  Target: SOD1; (+) strand; PAM type: YTN; PAM sequence: TTT
gtttatagatttcttcttaa

SEQ ID NO: 16415 - DNA, 20 bp, Artificial Sequence
  Description of Artificial Sequence: Synthetic oligonucleotide
  Target: SOD1; (+) strand; PAM type: YTN; PAM sequence: TTG
tttatagatttcttcttaaa

SEQ ID NO: 16416 - DNA, 20 bp, Artificial Sequence
  Description of Artificial Sequence: Synthetic oligonucleotide
  Target: SOD1; (+) strand; PAM type: YTN; PAM sequence: TTT
atagatttcttcttaaatta

SEQ ID NO: 16417 - DNA, 20 bp, Artificial Sequence
  Description of Artificial Sequence: Synthetic oligonucleotide
  Target: SOD1; (+) strand; PAM type: YTN; PAM sequence: TTA
tagatttcttcttaaattaa

SEQ ID NO: 16418 - DNA, 20 bp, Artificial Sequence
  Description of Artificial Sequence: Synthetic oligonucleotide
  Target: SOD1; (+) strand; PAM type: YTN; PAM sequence: TTT
cttcttaaattaactttatt

SEQ ID NO: 16419 - DNA, 20 bp, Artificial Sequence
  Description of Artificial Sequence: Synthetic oligonucleotide
  Target: SOD1; (+) strand; PAM type: YTN; PAM sequence: TTC
ttcttaaattaactttattc

SEQ ID NO: 16420 - DNA, 20 bp, Artificial Sequence
  Description of Artificial Sequence: Synthetic oligonucleotide
  Target: SOD1; (+) strand; PAM type: YTN; PAM sequence: CTT
cttaaattaactttattcat

SEQ ID NO: 16421 - DNA, 20 bp, Artificial Sequence
  Description of Artificial Sequence: Synthetic oligonucleotide
  Target: SOD1; (+) strand; PAM type: YTN; PAM sequence: TTC
ttaaattaactttattcatc

SEQ ID NO: 16422 - DNA, 20 bp, Artificial Sequence
  Description of Artificial Sequence: Synthetic oligonucleotide
  Target: SOD1; (+) strand; PAM type: YTN; PAM sequence: CTT
aaattaactttattcatctt

SEQ ID NO: 16423 - DNA, 20 bp, Artificial Sequence
  Description of Artificial Sequence: Synthetic oligonucleotide
  Target: SOD1; (+) strand; PAM type: YTN; PAM sequence: TTA
aattaactttattcatcttg

SEQ ID NO: 16424 - DNA, 20 bp, Artificial Sequence
  Description of Artificial Sequence: Synthetic oligonucleotide
  Target: SOD1; (+) strand; PAM type: YTN; PAM sequence: TTA
actttattcatcttgctaat

SEQ ID NO: 16425 - DNA, 20 bp, Artificial Sequence
  Description of Artificial Sequence: Synthetic oligonucleotide
  Target: SOD1; (+) strand; PAM type: YTN; PAM sequence: CTT
tattcatcttgctaatttag

SEQ ID NO: 16426 - DNA, 20 bp, Artificial Sequence
  Description of Artificial Sequence: Synthetic oligonucleotide
  Target: SOD1; (+) strand; PAM type: YTN; PAM sequence: TTT
attcatcttgctaatttagt

SEQ ID NO: 16427 - DNA, 20 bp, Artificial Sequence
  Description of Artificial Sequence: Synthetic oligonucleotide
  Target: SOD1; (+) strand; PAM type: YTN; PAM sequence: TTA
ttcatcttgctaatttagtt

SEQ ID NO: 16428 - DNA, 20 bp, Artificial Sequence
  Description of Artificial Sequence: Synthetic oligonucleotide
  Target: SOD1; (+) strand; PAM type: YTN; PAM sequence: TTC
atcttgctaatttagtttca

SEQ ID NO: 16429 - DNA, 20 bp, Artificial Sequence
  Description of Artificial Sequence: Synthetic oligonucleotide
  Target: SOD1; (+) strand; PAM type: YTN; PAM sequence: CTT
gctaatttagtttcaaatag

SEQ ID NO: 16430 - DNA, 20 bp, Artificial Sequence
  Description of Artificial Sequence: Synthetic oligonucleotide
  Target: SOD1; (+) strand; PAM type: YTN; PAM sequence: TTG
ctaatttagtttcaaatagt

SEQ ID NO: 16431 - DNA, 20 bp, Artificial Sequence
  Description of Artificial Sequence: Synthetic oligonucleotide
  Target: SOD1; (+) strand; PAM type: YTN; PAM sequence: CTA
atttagtttcaaatagtgat

SEQ ID NO: 16432 - DNA, 20 bp, Artificial Sequence
  Description of Artificial Sequence: Synthetic oligonucleotide
  Target: SOD1; (+) strand; PAM type: YTN; PAM sequence: TTT
agtttcaaatagtgatttgt

SEQ ID NO: 16433 - DNA, 20 bp, Artificial Sequence
  Description of Artificial Sequence: Synthetic oligonucleotide
  Target: SOD1; (+) strand; PAM type: YTN; PAM sequence: TTA
gtttcaaatagtgatttgta

SEQ ID NO: 16434 - DNA, 20 bp, Artificial Sequence
  Description of Artificial Sequence: Synthetic oligonucleotide
  Target: SOD1; (+) strand; PAM type: YTN; PAM sequence: TTT
caaatagtgatttgtaatga

SEQ ID NO: 16435 - DNA, 20 bp, Artificial Sequence
  Description of Artificial Sequence: Synthetic oligonucleotide
  Target: SOD1; (+) strand; PAM type: YTN; PAM sequence: TTC
aaatagtgatttgtaatgat

SEQ ID NO: 16436 - DNA, 20 bp, Artificial Sequence
  Description of Artificial Sequence: Synthetic oligonucleotide
  Target: SOD1; (+) strand; PAM type: YTN; PAM sequence: TTT
gtaatgatcagatttgatcc

SEQ ID NO: 16437 - DNA, 20 bp, Artificial Sequence
  Description of Artificial Sequence: Synthetic oligonucleotide
  Target: SOD1; (+) strand; PAM type: YTN; PAM sequence: TTG
taatgatcagatttgatcca

SEQ ID NO: 16438 - DNA, 20 bp, Artificial Sequence
  Description of Artificial Sequence: Synthetic oligonucleotide
  Target: SOD1; (+) strand; PAM type: YTN; PAM sequence: TTT
gatccatttctgtaattgct

SEQ ID NO: 16439 - DNA, 20 bp, Artificial Sequence
  Description of Artificial Sequence: Synthetic oligonucleotide
  Target: SOD1; (+) strand; PAM type: YTN; PAM sequence: TTG
atccatttctgtaattgctg

SEQ ID NO: 16440 - DNA, 20 bp, Artificial Sequence
  Description of Artificial Sequence: Synthetic oligonucleotide
  Target: SOD1; (+) strand; PAM type: YTN; PAM sequence: TTT
ctgtaattgctgaaattccc

SEQ ID NO: 16441 - DNA, 20 bp, Artificial Sequence
  Description of Artificial Sequence: Synthetic oligonucleotide
  Target: SOD1; (+) strand; PAM type: YTN; PAM sequence: TTC
tgtaattgctgaaattcccc

SEQ ID NO: 16442 - DNA, 20 bp, Artificial Sequence
  Description of Artificial Sequence: Synthetic oligonucleotide
  Target: SOD1; (+) strand; PAM type: YTN; PAM sequence: CTG
taattgctgaaattcccccg

SEQ ID NO: 16443 - DNA, 20 bp, Artificial Sequence
  Description of Artificial Sequence: Synthetic oligonucleotide
  Target: SOD1; (+) strand; PAM type: YTN; PAM sequence: TTG
ctgaaattcccccgagttgc

SEQ ID NO: 16444 - DNA, 20 bp, Artificial Sequence
  Description of Artificial Sequence: Synthetic oligonucleotide
  Target: SOD1; (+) strand; PAM type: YTN; PAM sequence: CTG
aaattcccccgagttgcttt

SEQ ID NO: 16445 - DNA, 20 bp, Artificial Sequence
  Description of Artificial Sequence: Synthetic oligonucleotide
  Target: SOD1; (+) strand; PAM type: YTN; PAM sequence: TTC
ccccgagttgctttttggct

SEQ ID NO: 16446 - DNA, 20 bp, Artificial Sequence
  Description of Artificial Sequence: Synthetic oligonucleotide
  Target: SOD1; (+) strand; PAM type: YTN; PAM sequence: TTG
ctttttggctttaccgcctc

SEQ ID NO: 16447 - DNA, 20 bp, Artificial Sequence
  Description of Artificial Sequence: Synthetic oligonucleotide
  Target: SOD1; (+) strand; PAM type: YTN; PAM sequence: CTT
tttggctttaccgcctctgg

SEQ ID NO: 16448 - DNA, 20 bp, Artificial Sequence
  Description of Artificial Sequence: Synthetic oligonucleotide
  Target: SOD1; (+) strand; PAM type: YTN; PAM sequence: TTT
ttggctttaccgcctctggt

SEQ ID NO: 16449 - DNA, 20 bp, Artificial Sequence
  Description of Artificial Sequence: Synthetic oligonucleotide
  Target: SOD1; (+) strand; PAM type: YTN; PAM sequence: TTT
tggctttaccgcctctggtc

SEQ ID NO: 16450 - DNA, 20 bp, Artificial Sequence
  Description of Artificial Sequence: Synthetic oligonucleotide
  Target: SOD1; (+) strand; PAM type: YTN; PAM sequence: TTT
ggctttaccgcctctggtct

SEQ ID NO: 16451 - DNA, 20 bp, Artificial Sequence
  Description of Artificial Sequence: Synthetic oligonucleotide
  Target: SOD1; (+) strand; PAM type: YTN; PAM sequence: TTG
gctttaccgcctctggtctg

SEQ ID NO: 16452 - DNA, 20 bp, Artificial Sequence
  Description of Artificial Sequence: Synthetic oligonucleotide
  Target: SOD1; (+) strand; PAM type: YTN; PAM sequence: CTT
taccgcctctggtctgggag

SEQ ID NO: 16453 - DNA, 20 bp, Artificial Sequence
  Description of Artificial Sequence: Synthetic oligonucleotide
  Target: SOD1; (+) strand; PAM type: YTN; PAM sequence: TTT
accgcctctggtctgggagg

SEQ ID NO: 16454 - DNA, 20 bp, Artificial Sequence
  Description of Artificial Sequence: Synthetic oligonucleotide
  Target: SOD1; (+) strand; PAM type: YTN; PAM sequence: TTA
ccgcctctggtctgggaggt

SEQ ID NO: 16455 - DNA, 20 bp, Artificial Sequence
  Description of Artificial Sequence: Synthetic oligonucleotide
  Target: SOD1; (+) strand; PAM type: YTN; PAM sequence: CTC
tggtctgggaggtgattgct

SEQ ID NO: 16456 - DNA, 20 bp, Artificial Sequence
  Description of Artificial Sequence: Synthetic oligonucleotide
  Target: SOD1; (+) strand; PAM type: YTN; PAM sequence: CTG
gtctgggaggtgattgctct

SEQ ID NO: 16457 - DNA, 20 bp, Artificial Sequence
  Description of Artificial Sequence: Synthetic oligonucleotide
  Target: SOD1; (+) strand; PAM type: YTN; PAM sequence: CTG
ggaggtgattgctctgctgc

SEQ ID NO: 16458 - DNA, 20 bp, Artificial Sequence
  Description of Artificial Sequence: Synthetic oligonucleotide
  Target: SOD1; (+) strand; PAM type: YTN; PAM sequence: TTG
ctctgctgcttcctgtaact

SEQ ID NO: 16459 - DNA, 20 bp, Artificial Sequence
  Description of Artificial Sequence: Synthetic oligonucleotide
  Target: SOD1; (+) strand; PAM type: YTN; PAM sequence: CTC
tgctgcttcctgtaacttgc

SEQ ID NO: 16460 - DNA, 20 bp, Artificial Sequence
  Description of Artificial Sequence: Synthetic oligonucleotide
  Target: SOD1; (+) strand; PAM type: YTN; PAM sequence: CTG
ctgcttcctgtaacttgcct

SEQ ID NO: 16461 - DNA, 20 bp, Artificial Sequence
  Description of Artificial Sequence: Synthetic oligonucleotide
  Target: SOD1; (+) strand; PAM type: YTN; PAM sequence: CTG
cttcctgtaacttgcctgcc

SEQ ID NO: 16462 - DNA, 20 bp, Artificial Sequence
  Description of Artificial Sequence: Synthetic oligonucleotide
  Target: SOD1; (+) strand; PAM type: YTN; PAM sequence: CTT
cctgtaacttgcctgccttt

SEQ ID NO: 16463 - DNA, 20 bp, Artificial Sequence
  Description of Artificial Sequence: Synthetic oligonucleotide
  Target: SOD1; (+) strand; PAM type: YTN; PAM sequence: TTC
ctgtaacttgcctgcctttc

SEQ ID NO: 16464 - DNA, 20 bp, Artificial Sequence
  Description of Artificial Sequence: Synthetic oligonucleotide
  Target: SOD1; (+) strand; PAM type: YTN; PAM sequence: CTG
taacttgcctgcctttctcc

SEQ ID NO: 16465 - DNA, 20 bp, Artificial Sequence
  Description of Artificial Sequence: Synthetic oligonucleotide
  Target: SOD1; (+) strand; PAM type: YTN; PAM sequence: CTT
gcctgcctttctccctgtgt

SEQ ID NO: 16466 - DNA, 20 bp, Artificial Sequence
  Description of Artificial Sequence: Synthetic oligonucleotide
  Target: SOD1; (+) strand; PAM type: YTN; PAM sequence: TTG
cctgcctttctccctgtgtg

SEQ ID NO: 16467 - DNA, 20 bp, Artificial Sequence
  Description of Artificial Sequence: Synthetic oligonucleotide
  Target: SOD1; (+) strand; PAM type: YTN; PAM sequence: CTG
cctttctccctgtgtgggac

SEQ ID NO: 16468 - DNA, 20 bp, Artificial Sequence
  Description of Artificial Sequence: Synthetic oligonucleotide
  Target: SOD1; (+) strand; PAM type: YTN; PAM sequence: CTT
tctccctgtgtgggactcct

SEQ ID NO: 16469 - DNA, 20 bp, Artificial Sequence
  Description of Artificial Sequence: Synthetic oligonucleotide
  Target: SOD1; (+) strand; PAM type: YTN; PAM sequence: TTT
ctccctgtgtgggactcctg

SEQ ID NO: 16470 - DNA, 20 bp, Artificial Sequence
  Description of Artificial Sequence: Synthetic oligonucleotide
  Target: SOD1; (+) strand; PAM type: YTN; PAM sequence: TTC
tccctgtgtgggactcctgc

SEQ ID NO: 16471 - DNA, 20 bp, Artificial Sequence
  Description of Artificial Sequence: Synthetic oligonucleotide
  Target: SOD1; (+) strand; PAM type: YTN; PAM sequence: CTC
cctgtgtgggactcctgcgg

SEQ ID NO: 16472 - DNA, 20 bp, Artificial Sequence
  Description of Artificial Sequence: Synthetic oligonucleotide
  Target: SOD1; (+) strand; PAM type: YTN; PAM sequence: CTG
tgtgggactcctgcgggtga

SEQ ID NO: 16473 - DNA, 20 bp, Artificial Sequence
  Description of Artificial Sequence: Synthetic oligonucleotide
  Target: SOD1; (+) strand; PAM type: YTN; PAM sequence: CTC
ctgcgggtgagagcgtggct

SEQ ID NO: 16474 - DNA, 20 bp, Artificial Sequence
  Description of Artificial Sequence: Synthetic oligonucleotide
  Target: SOD1; (+) strand; PAM type: YTN; PAM sequence: CTG
cgggtgagagcgtggctgaa

SEQ ID NO: 16475 - DNA, 20 bp, Artificial Sequence
  Description of Artificial Sequence: Synthetic oligonucleotide
  Target: SOD1; (+) strand; PAM type: YTN; PAM sequence: CTG
aagacagccgtgttatgaaa

SEQ ID NO: 16476 - DNA, 20 bp, Artificial Sequence
  Description of Artificial Sequence: Synthetic oligonucleotide
  Target: SOD1; (+) strand; PAM type: YTN; PAM sequence: TTA
tgaaagggcctcctgtgctg

SEQ ID NO: 16477 - DNA, 20 bp, Artificial Sequence
  Description of Artificial Sequence: Synthetic oligonucleotide
  Target: SOD1; (+) strand; PAM type: YTN; PAM sequence: CTC
ctgtgctgtcgaggttgtgc

SEQ ID NO: 16478 - DNA, 20 bp, Artificial Sequence
  Description of Artificial Sequence: Synthetic oligonucleotide
  Target: SOD1; (+) strand; PAM type: YTN; PAM sequence: CTG
tgctgtcgaggttgtgctct

SEQ ID NO: 16479 - DNA, 20 bp, Artificial Sequence
  Description of Artificial Sequence: Synthetic oligonucleotide
  Target: SOD1; (+) strand; PAM type: YTN; PAM sequence: CTG
tcgaggttgtgctctgtgaa

SEQ ID NO: 16480 - DNA, 20 bp, Artificial Sequence
  Description of Artificial Sequence: Synthetic oligonucleotide
  Target: SOD1; (+) strand; PAM type: YTN; PAM sequence: TTG
tgctctgtgaatgtcatccc

SEQ ID NO: 16481 - DNA, 20 bp, Artificial Sequence
  Description of Artificial Sequence: Synthetic oligonucleotide
  Target: SOD1; (+) strand; PAM type: YTN; PAM sequence: CTC
tgtgaatgtcatcccctggt

SEQ ID NO: 16482 - DNA, 20 bp, Artificial Sequence
  Description of Artificial Sequence: Synthetic oligonucleotide
  Target: SOD1; (+) strand; PAM type: YTN; PAM sequence: CTG
tgaatgtcatcccctggtgc

SEQ ID NO: 16483 - DNA, 20 bp, Artificial Sequence
  Description of Artificial Sequence: Synthetic oligonucleotide
  Target: SOD1; (+) strand; PAM type: YTN; PAM sequence: CTG
gtgcacagcagcaccttcta

SEQ ID NO: 16484 - DNA, 20 bp, Artificial Sequence
  Description of Artificial Sequence: Synthetic oligonucleotide
  Target: SOD1; (+) strand; PAM type: YTN; PAM sequence: CTT
ctacacaggatacagttgga

SEQ ID NO: 16485 - DNA, 20 bp, Artificial Sequence
  Description of Artificial Sequence: Synthetic oligonucleotide
  Target: SOD1; (+) strand; PAM type: YTN; PAM sequence: TTC
tacacaggatacagttggaa

SEQ ID NO: 16486 - DNA, 20 bp, Artificial Sequence
  Description of Artificial Sequence: Synthetic oligonucleotide
  Target: SOD1; (+) strand; PAM type: YTN; PAM sequence: CTA
cacaggatacagttggaatg

SEQ ID NO: 16487 - DNA, 20 bp, Artificial Sequence
  Description of Artificial Sequence: Synthetic oligonucleotide
  Target: SOD1; (+) strand; PAM type: YTN; PAM sequence: TTG
gaatgccgccccctcgagtt

SEQ ID NO: 16488 - DNA, 20 bp, Artificial Sequence
  Description of Artificial Sequence: Synthetic oligonucleotide
  Target: SOD1; (+) strand; PAM type: YTN; PAM sequence: CTC
gagttgtgtaaggcagcagc

SEQ ID NO: 16489 - DNA, 20 bp, Artificial Sequence
  Description of Artificial Sequence: Synthetic oligonucleotide
  Target: SOD1; (+) strand; PAM type: YTN; PAM sequence: TTG
tgtaaggcagcagccttggc

SEQ ID NO: 16490 - DNA, 20 bp, Artificial Sequence
  Description of Artificial Sequence: Synthetic oligonucleotide
  Target: SOD1; (+) strand; PAM type: YTN; PAM sequence: CTT
ggcccttgcacataagatgc

SEQ ID NO: 16491 - DNA, 20 bp, Artificial Sequence
  Description of Artificial Sequence: Synthetic oligonucleotide
  Target: SOD1; (+) strand; PAM type: YTN; PAM sequence: TTG
gcccttgcacataagatgct

SEQ ID NO: 16492 - DNA, 20 bp, Artificial Sequence
  Description of Artificial Sequence: Synthetic oligonucleotide
  Target: SOD1; (+) strand; PAM type: YTN; PAM sequence: CTT
gcacataagatgctgttgaa

SEQ ID NO: 16493 - DNA, 20 bp, Artificial Sequence
  Description of Artificial Sequence: Synthetic oligonucleotide
  Target: SOD1; (+) strand; PAM type: YTN; PAM sequence: TTG
cacataagatgctgttgaat

SEQ ID NO: 16494 - DNA, 20 bp, Artificial Sequence
  Description of Artificial Sequence: Synthetic oligonucleotide
  Target: SOD1; (+) strand; PAM type: YTN; PAM sequence: CTG
ttgaatattctgcctgcacc

SEQ ID NO: 16495 - DNA, 20 bp, Artificial Sequence
  Description of Artificial Sequence: Synthetic oligonucleotide
  Target: SOD1; (+) strand; PAM type: YTN; PAM sequence: TTG
aatattctgcctgcaccaag

SEQ ID NO: 16496 - DNA, 20 bp, Artificial Sequence
  Description of Artificial Sequence: Synthetic oligonucleotide
  Target: SOD1; (+) strand; PAM type: YTN; PAM sequence: TTC
tgcctgcaccaagtaaaggg

SEQ ID NO: 16497 - DNA, 20 bp, Artificial Sequence
  Description of Artificial Sequence: Synthetic oligonucleotide
  Target: SOD1; (+) strand; PAM type: YTN; PAM sequence: CTG
cctgcaccaagtaaagggca

SEQ ID NO: 16498 - DNA, 20 bp, Artificial Sequence
  Description of Artificial Sequence: Synthetic oligonucleotide
  Target: SOD1; (+) strand; PAM type: YTN; PAM sequence: CTG
caccaagtaaagggcacaga

SEQ ID NO: 16499 - DNA, 20 bp, Artificial Sequence
  Description of Artificial Sequence: Synthetic oligonucleotide
  Target: SOD1; (+) strand; PAM type: YTN; PAM sequence: CTG
cttggcatatgttgctgggg

SEQ ID NO: 16500 - DNA, 20 bp, Artificial Sequence
  Description of Artificial Sequence: Synthetic oligonucleotide
  Target: SOD1; (+) strand; PAM type: YTN; PAM sequence: CTT
ggcatatgttgctggggaga

SEQ ID NO: 16501 - DNA, 20 bp, Artificial Sequence
  Description of Artificial Sequence: Synthetic oligonucleotide
  Target: SOD1; (+) strand; PAM type: YTN; PAM sequence: TTG
gcatatgttgctggggagat

SEQ ID NO: 16502 - DNA, 20 bp, Artificial Sequence
  Description of Artificial Sequence: Synthetic oligonucleotide
  Target: SOD1; (+) strand; PAM type: YTN; PAM sequence: TTG
ctggggagatgagttttttg

SEQ ID NO: 16503 - DNA, 20 bp, Artificial Sequence
  Description of Artificial Sequence: Synthetic oligonucleotide
  Target: SOD1; (+) strand; PAM type: YTN; PAM sequence: CTG
gggagatgagttttttgtaa

SEQ ID NO: 16504 - DNA, 20 bp, Artificial Sequence
  Description of Artificial Sequence: Synthetic oligonucleotide
  Target: SOD1; (+) strand; PAM type: YTN; PAM sequence: TTT
tttgtaaagtatactacgtt

SEQ ID NO: 16505 - DNA, 20 bp, Artificial Sequence
  Description of Artificial Sequence: Synthetic oligonucleotide
  Target: SOD1; (+) strand; PAM type: YTN; PAM sequence: TTT
ttgtaaagtatactacgttc

SEQ ID NO: 16506 - DNA, 20 bp, Artificial Sequence
  Description of Artificial Sequence: Synthetic oligonucleotide
  Target: SOD1; (+) strand; PAM type: YTN; PAM sequence: TTT
tgtaaagtatactacgttct

SEQ ID NO: 16507 - DNA, 20 bp, Artificial Sequence
  Description of Artificial Sequence: Synthetic oligonucleotide
  Target: SOD1; (+) strand; PAM type: YTN; PAM sequence: TTT
gtaaagtatactacgttctt

SEQ ID NO: 16508 - DNA, 20 bp, Artificial Sequence
  Description of Artificial Sequence: Synthetic oligonucleotide
  Target: SOD1; (+) strand; PAM type: YTN; PAM sequence: TTG
taaagtatactacgttctta

SEQ ID NO: 16509 - DNA, 20 bp, Artificial Sequence
  Description of Artificial Sequence: Synthetic oligonucleotide
  Target: SOD1; (+) strand; PAM type: YTN; PAM sequence: CTA
cgttcttaagaatttggatc

SEQ ID NO: 16510 - DNA, 20 bp, Artificial Sequence
  Description of Artificial Sequence: Synthetic oligonucleotide
  Target: SOD1; (+) strand; PAM type: YTN; PAM sequence: TTC
ttaagaatttggatcataac

SEQ ID NO: 16511 - DNA, 20 bp, Artificial Sequence
  Description of Artificial Sequence: Synthetic oligonucleotide
  Target: SOD1; (+) strand; PAM type: YTN; PAM sequence: CTT
aagaatttggatcataacca

SEQ ID NO: 16512 - DNA, 20 bp, Artificial Sequence
  Description of Artificial Sequence: Synthetic oligonucleotide
  Target: SOD1; (+) strand; PAM type: YTN; PAM sequence: TTA
agaatttggatcataaccat

SEQ ID NO: 16513 - DNA, 20 bp, Artificial Sequence
  Description of Artificial Sequence: Synthetic oligonucleotide
  Target: SOD1; (+) strand; PAM type: YTN; PAM sequence: TTT
ggatcataaccatgggattt

SEQ ID NO: 16514 - DNA, 20 bp, Artificial Sequence
  Description of Artificial Sequence: Synthetic oligonucleotide
  Target: SOD1; (+) strand; PAM type: YTN; PAM sequence: TTG
gatcataaccatgggatttt

SEQ ID NO: 16515 - DNA, 20 bp, Artificial Sequence
  Description of Artificial Sequence: Synthetic oligonucleotide
  Target: SOD1; (+) strand; PAM type: YTN; PAM sequence: TTT
taataatagaaaaactgttg

SEQ ID NO: 16516 - DNA, 20 bp, Artificial Sequence
  Description of Artificial Sequence: Synthetic oligonucleotide
  Target: SOD1; (+) strand; PAM type: YTN; PAM sequence: TTT
aataatagaaaaactgttga

SEQ ID NO: 16517 - DNA, 20 bp, Artificial Sequence
  Description of Artificial Sequence: Synthetic oligonucleotide
  Target: SOD1; (+) strand; PAM type: YTN; PAM sequence: TTA
ataatagaaaaactgttgaa

SEQ ID NO: 16518 - DNA, 20 bp, Artificial Sequence
  Description of Artificial Sequence: Synthetic oligonucleotide
  Target: SOD1; (+) strand; PAM type: YTN; PAM sequence: CTG
ttgaagatcagtctggtccc

SEQ ID NO: 16519 - DNA, 20 bp, Artificial Sequence
  Description of Artificial Sequence: Synthetic oligonucleotide
  Target: SOD1; (+) strand; PAM type: YTN; PAM sequence: TTG
aagatcagtctggtccctta

SEQ ID NO: 16520 - DNA, 20 bp, Artificial Sequence
  Description of Artificial Sequence: Synthetic oligonucleotide
  Target: SOD1; (+) strand; PAM type: YTN; PAM sequence: CTG
gtcccttatttttacagtga

SEQ ID NO: 16521 - DNA, 20 bp, Artificial Sequence
  Description of Artificial Sequence: Synthetic oligonucleotide
  Target: SOD1; (+) strand; PAM type: YTN; PAM sequence: CTT
atttttacagtgaagaagcc

SEQ ID NO: 16522 - DNA, 20 bp, Artificial Sequence
  Description of Artificial Sequence: Synthetic oligonucleotide
  Target: SOD1; (+) strand; PAM type: YTN; PAM sequence: TTA
tttttacagtgaagaagcca

SEQ ID NO: 16523 - DNA, 20 bp, Artificial Sequence
  Description of Artificial Sequence: Synthetic oligonucleotide
  Target: SOD1; (+) strand; PAM type: YTN; PAM sequence: TTT
ttacagtgaagaagccaaag

SEQ ID NO: 16524 - DNA, 20 bp, Artificial Sequence
  Description of Artificial Sequence: Synthetic oligonucleotide
  Target: SOD1; (+) strand; PAM type: YTN; PAM sequence: TTT
tacagtgaagaagccaaagc

SEQ ID NO: 16525 - DNA, 20 bp, Artificial Sequence
  Description of Artificial Sequence: Synthetic oligonucleotide
  Target: SOD1; (+) strand; PAM type: YTN; PAM sequence: TTT
acagtgaagaagccaaagcc

SEQ ID NO: 16526 - DNA, 20 bp, Artificial Sequence
  Description of Artificial Sequence: Synthetic oligonucleotide
  Target: SOD1; (+) strand; PAM type: YTN; PAM sequence: TTA
cagtgaagaagccaaagccc

SEQ ID NO: 16527 - DNA, 20 bp, Artificial Sequence
  Description of Artificial Sequence: Synthetic oligonucleotide
  Target: SOD1; (+) strand; PAM type: YTN; PAM sequence: TTA
actttacaagtgtcagacag

SEQ ID NO: 16528 - DNA, 20 bp, Artificial Sequence
  Description of Artificial Sequence: Synthetic oligonucleotide
  Target: SOD1; (+) strand; PAM type: YTN; PAM sequence: CTT
tacaagtgtcagacagtagt

SEQ ID NO: 16529 - DNA, 20 bp, Artificial Sequence
  Description of Artificial Sequence: Synthetic oligonucleotide
  Target: SOD1; (+) strand; PAM type: YTN; PAM sequence: TTT
acaagtgtcagacagtagtt

SEQ ID NO: 16530 - DNA, 20 bp, Artificial Sequence
  Description of Artificial Sequence: Synthetic oligonucleotide
  Target: SOD1; (+) strand; PAM type: YTN; PAM sequence: TTA
caagtgtcagacagtagtta

SEQ ID NO: 16531 - DNA, 20 bp, Artificial Sequence
  Description of Artificial Sequence: Synthetic oligonucleotide
  Target: SOD1; (+) strand; PAM type: YTN; PAM sequence: TTA
gaacttggtggggttttttt

SEQ ID NO: 16532 - DNA, 20 bp, Artificial Sequence
  Description of Artificial Sequence: Synthetic oligonucleotide
  Target: SOD1; (+) strand; PAM type: YTN; PAM sequence: CTT
ggtggggttttttttttttt

SEQ ID NO: 16533 - DNA, 20 bp, Artificial Sequence
  Description of Artificial Sequence: Synthetic oligonucleotide
  Target: SOD1; (+) strand; PAM type: YTN; PAM sequence: TTG
gtggggtttttttttttttt

SEQ ID NO: 16534 - DNA, 20 bp, Artificial Sequence
  Description of Artificial Sequence: Synthetic oligonucleotide
  Target: SOD1; (+) strand; PAM type: YTN; PAM sequence: TTT
ttttttttttttttttgaga

SEQ ID NO: 16535 - DNA, 20 bp, Artificial Sequence
  Description of Artificial Sequence: Synthetic oligonucleotide
  Target: SOD1; (+) strand; PAM type: YTN; PAM sequence: TTT
tttttttttttttttgagat

SEQ ID NO: 16536 - DNA, 20 bp, Artificial Sequence
  Description of Artificial Sequence: Synthetic oligonucleotide
  Target: SOD1; (+) strand; PAM type: YTN; PAM sequence: TTT
ttttttttttttttgagatg

SEQ ID NO: 16537 - DNA, 20 bp, Artificial Sequence
  Description of Artificial Sequence: Synthetic oligonucleotide
  Target: SOD1; (+) strand; PAM type: YTN; PAM sequence: TTT
tttttttttttttgagatgg

SEQ ID NO: 16538 - DNA, 20 bp, Artificial Sequence
  Description of Artificial Sequence: Synthetic oligonucleotide
  Target: SOD1; (+) strand; PAM type: YTN; PAM sequence: TTT
ttttttttttttgagatgga

SEQ ID NO: 16539 - DNA, 20 bp, Artificial Sequence
  Description of Artificial Sequence: Synthetic oligonucleotide
  Target: SOD1; (+) strand; PAM type: YTN; PAM sequence: TTT
tttttttttttgagatggag

SEQ ID NO: 16540 - DNA, 20 bp, Artificial Sequence
  Description of Artificial Sequence: Synthetic oligonucleotide
  Target: SOD1; (+) strand; PAM type: YTN; PAM sequence: TTT
ttttttttttgagatggagt

SEQ ID NO: 16541 - DNA, 20 bp, Artificial Sequence
  Description of Artificial Sequence: Synthetic oligonucleotide
  Target: SOD1; (+) strand; PAM type: YTN; PAM sequence: TTT
tttttttttgagatggagtc

SEQ ID NO: 16542 - DNA, 20 bp, Artificial Sequence
  Description of Artificial Sequence: Synthetic oligonucleotide
  Target: SOD1; (+) strand; PAM type: YTN; PAM sequence: TTT
ttttttttgagatggagtct

SEQ ID NO: 16543 - DNA, 20 bp, Artificial Sequence
  Description of Artificial Sequence: Synthetic oligonucleotide
  Target: SOD1; (+) strand; PAM type: YTN; PAM sequence: TTT
tttttttgagatggagtctt

SEQ ID NO: 16544 - DNA, 20 bp, Artificial Sequence
  Description of Artificial Sequence: Synthetic oligonucleotide
  Target: SOD1; (+) strand; PAM type: YTN; PAM sequence: TTT
ttttttgagatggagtcttg

SEQ ID NO: 16545 - DNA, 20 bp, Artificial Sequence
  Description of Artificial Sequence: Synthetic oligonucleotide
  Target: SOD1; (+) strand; PAM type: YTN; PAM sequence: TTT
tttttgagatggagtcttgc

SEQ ID NO: 16546 - DNA, 20 bp, Artificial Sequence
  Description of Artificial Sequence: Synthetic oligonucleotide
  Target: SOD1; (+) strand; PAM type: YTN; PAM sequence: TTT
ttttgagatggagtcttgct

SEQ ID NO: 16547 - DNA, 20 bp, Artificial Sequence
  Description of Artificial Sequence: Synthetic oligonucleotide
  Target: SOD1; (+) strand; PAM type: YTN; PAM sequence: TTT
tttgagatggagtcttgctc

SEQ ID NO: 16548 - DNA, 20 bp, Artificial Sequence
  Description of Artificial Sequence: Synthetic oligonucleotide
  Target: SOD1; (+) strand; PAM type: YTN; PAM sequence: TTT
ttgagatggagtcttgctct

SEQ ID NO: 16549 - DNA, 20 bp, Artificial Sequence
  Description of Artificial Sequence: Synthetic oligonucleotide
  Target: SOD1; (+) strand; PAM type: YTN; PAM sequence: TTT
tgagatggagtcttgctctg

SEQ ID NO: 16550 - DNA, 20 bp, Artificial Sequence
  Description of Artificial Sequence: Synthetic oligonucleotide
  Target: SOD1; (+) strand; PAM type: YTN; PAM sequence: TTT
gagatggagtcttgctctgt

SEQ ID NO: 16551 - DNA, 20 bp, Artificial Sequence
  Description of Artificial Sequence: Synthetic oligonucleotide
  Target: SOD1; (+) strand; PAM type: YTN; PAM sequence: TTG
agatggagtcttgctctgtt

SEQ ID NO: 16552 - DNA, 20 bp, Artificial Sequence
  Description of Artificial Sequence: Synthetic oligonucleotide
  Target: SOD1; (+) strand; PAM type: YTN; PAM sequence: CTT
gctctgttgcccaggctgga

SEQ ID NO: 16553 - DNA, 20 bp, Artificial Sequence
  Description of Artificial Sequence: Synthetic oligonucleotide
  Target: SOD1; (+) strand; PAM type: YTN; PAM sequence: TTG
ctctgttgcccaggctggag

SEQ ID NO: 16554 - DNA, 20 bp, Artificial Sequence
  Description of Artificial Sequence: Synthetic oligonucleotide
  Target: SOD1; (+) strand; PAM type: YTN; PAM sequence: CTC
tgttgcccaggctggagtgc

SEQ ID NO: 16555 - DNA, 20 bp, Artificial Sequence
  Description of Artificial Sequence: Synthetic oligonucleotide
  Target: SOD1; (+) strand; PAM type: YTN; PAM sequence: CTG
ttgcccaggctggagtgcag

SEQ ID NO: 16556 - DNA, 20 bp, Artificial Sequence
  Description of Artificial Sequence: Synthetic oligonucleotide
  Target: SOD1; (+) strand; PAM type: YTN; PAM sequence: TTG
cccaggctggagtgcagtgg

SEQ ID NO: 16557 - DNA, 20 bp, Artificial Sequence
  Description of Artificial Sequence: Synthetic oligonucleotide
  Target: SOD1; (+) strand; PAM type: YTN; PAM sequence: CTG
gagtgcagtggtgcgatctc

SEQ ID NO: 16558 - DNA, 20 bp, Artificial Sequence
  Description of Artificial Sequence: Synthetic oligonucleotide
  Target: SOD1; (+) strand; PAM type: YTN; PAM sequence: CTC
agctcactgcaacctctgcc

SEQ ID NO: 16559 - DNA, 20 bp, Artificial Sequence
  Description of Artificial Sequence: Synthetic oligonucleotide
  Target: SOD1; (+) strand; PAM type: YTN; PAM sequence: CTC
actgcaacctctgcctccca

SEQ ID NO: 16560 - DNA, 20 bp, Artificial Sequence
  Description of Artificial Sequence: Synthetic oligonucleotide
  Target: SOD1; (+) strand; PAM type: YTN; PAM sequence: CTG
caacctctgcctcccaggtt

SEQ ID NO: 16561 - DNA, 20 bp, Artificial Sequence
  Description of Artificial Sequence: Synthetic oligonucleotide
  Target: SOD1; (+) strand; PAM type: YTN; PAM sequence: CTC
tgcctcccaggttcaagcga

SEQ ID NO: 16562 - DNA, 20 bp, Artificial Sequence
  Description of Artificial Sequence: Synthetic oligonucleotide
  Target: SOD1; (+) strand; PAM type: YTN; PAM sequence: CTG
cctcccaggttcaagcgatt

SEQ ID NO: 16563 - DNA, 20 bp, Artificial Sequence
  Description of Artificial Sequence: Synthetic oligonucleotide
  Target: SOD1; (+) strand; PAM type: YTN; PAM sequence: CTC
ccaggttcaagcgattctcc

SEQ ID NO: 16564 - DNA, 20 bp, Artificial Sequence
  Description of Artificial Sequence: Synthetic oligonucleotide
  Target: SOD1; (+) strand; PAM type: YTN; PAM sequence: TTC
aagcgattctcctgcctcag

SEQ ID NO: 16565 - DNA, 20 bp, Artificial Sequence
  Description of Artificial Sequence: Synthetic oligonucleotide
  Target: SOD1; (+) strand; PAM type: YTN; PAM sequence: TTC
tcctgcctcagcctactaag

SEQ ID NO: 16566 - DNA, 20 bp, Artificial Sequence
  Description of Artificial Sequence: Synthetic oligonucleotide
  Target: SOD1; (+) strand; PAM type: YTN; PAM sequence: CTC
ctgcctcagcctactaagta

SEQ ID NO: 16567 - DNA, 20 bp, Artificial Sequence
  Description of Artificial Sequence: Synthetic oligonucleotide
  Target: SOD1; (+) strand; PAM type: YTN; PAM sequence: CTG
cctcagcctactaagtagct

SEQ ID NO: 16568 - DNA, 20 bp, Artificial Sequence
  Description of Artificial Sequence: Synthetic oligonucleotide
  Target: SOD1; (+) strand; PAM type: YTN; PAM sequence: CTC
agcctactaagtagctggga

SEQ ID NO: 16569 - DNA, 20 bp, Artificial Sequence
  Description of Artificial Sequence: Synthetic oligonucleotide
  Target: SOD1; (+) strand; PAM type: YTN; PAM sequence: CTA
ctaagtagctgggactatag

SEQ ID NO: 16570 - DNA, 20 bp, Artificial Sequence
  Description of Artificial Sequence: Synthetic oligonucleotide
  Target: SOD1; (+) strand; PAM type: YTN; PAM sequence: CTA
agtagctgggactataggtg

SEQ ID NO: 16571 - DNA, 20 bp, Artificial Sequence
  Description of Artificial Sequence: Synthetic oligonucleotide
  Target: SOD1; (+) strand; PAM type: YTN; PAM sequence: CTG
ggactataggtgcgcaccac

SEQ ID NO: 16572 - DNA, 20 bp, Artificial Sequence
  Description of Artificial Sequence: Synthetic oligonucleotide
  Target: SOD1; (+) strand; PAM type: YTN; PAM sequence: CTA
taggtgcgcaccaccacgcc

SEQ ID NO: 16573 - DNA, 20 bp, Artificial Sequence
  Description of Artificial Sequence: Synthetic oligonucleotide
  Target: SOD1; (+) strand; PAM type: YTN; PAM sequence: CTA
gctaatttttgtattttttc

SEQ ID NO: 16574 - DNA, 20 bp, Artificial Sequence
  Description of Artificial Sequence: Synthetic oligonucleotide
  Target: SOD1; (+) strand; PAM type: YTN; PAM sequence: CTA
atttttgtattttttcagta

SEQ ID NO: 16575 - DNA, 20 bp, Artificial Sequence
  Description of Artificial Sequence: Synthetic oligonucleotide
  Target: SOD1; (+) strand; PAM type: YTN; PAM sequence: TTT
ttgtattttttcagtagaga

SEQ ID NO: 16576 - DNA, 20 bp, Artificial Sequence
  Description of Artificial Sequence: Synthetic oligonucleotide
  Target: SOD1; (+) strand; PAM type: YTN; PAM sequence: TTT
tgtattttttcagtagagac

SEQ ID NO: 16577 - DNA, 20 bp, Artificial Sequence
  Description of Artificial Sequence: Synthetic oligonucleotide
  Target: SOD1; (+) strand; PAM type: YTN; PAM sequence: TTT
gtattttttcagtagagaca

SEQ ID NO: 16578 - DNA, 20 bp, Artificial Sequence
  Description of Artificial Sequence: Synthetic oligonucleotide
  Target: SOD1; (+) strand; PAM type: YTN; PAM sequence: TTG
tattttttcagtagagacag

SEQ ID NO: 16579 - DNA, 20 bp, Artificial Sequence
  Description of Artificial Sequence: Synthetic oligonucleotide
  Target: SOD1; (+) strand; PAM type: YTN; PAM sequence: TTT
tttcagtagagacagggttt

SEQ ID NO: 16580 - DNA, 20 bp, Artificial Sequence
  Description of Artificial Sequence: Synthetic oligonucleotide
  Target: SOD1; (+) strand; PAM type: YTN; PAM sequence: TTT
ttcagtagagacagggtttt

SEQ ID NO: 16581 - DNA, 20 bp, Artificial Sequence
  Description of Artificial Sequence: Synthetic oligonucleotide
  Target: SOD1; (+) strand; PAM type: YTN; PAM sequence: TTT
tcagtagagacagggttttg

SEQ ID NO: 16582 - DNA, 20 bp, Artificial Sequence
  Description of Artificial Sequence: Synthetic oligonucleotide
  Target: SOD1; (+) strand; PAM type: YTN; PAM sequence: TTT
cagtagagacagggttttgc

SEQ ID NO: 16583 - DNA, 20 bp, Artificial Sequence
  Description of Artificial Sequence: Synthetic oligonucleotide
  Target: SOD1; (+) strand; PAM type: YTN; PAM sequence: TTC
agtagagacagggttttgct

SEQ ID NO: 16584 - DNA, 20 bp, Artificial Sequence
  Description of Artificial Sequence: Synthetic oligonucleotide
  Target: SOD1; (+) strand; PAM type: YTN; PAM sequence: TTT
tgctatgctggccaggctgg

SEQ ID NO: 16585 - DNA, 20 bp, Artificial Sequence
  Description of Artificial Sequence: Synthetic oligonucleotide
  Target: SOD1; (+) strand; PAM type: YTN; PAM sequence: TTT
gctatgctggccaggctggt

SEQ ID NO: 16586 - DNA, 20 bp, Artificial Sequence
  Description of Artificial Sequence: Synthetic oligonucleotide
  Target: SOD1; (+) strand; PAM type: YTN; PAM sequence: TTG
ctatgctggccaggctggtc

SEQ ID NO: 16587 - DNA, 20 bp, Artificial Sequence
  Description of Artificial Sequence: Synthetic oligonucleotide
  Target: SOD1; (+) strand; PAM type: YTN; PAM sequence: CTA
tgctggccaggctggtctca

SEQ ID NO: 16588 - DNA, 20 bp, Artificial Sequence
  Description of Artificial Sequence: Synthetic oligonucleotide
  Target: SOD1; (+) strand; PAM type: YTN; PAM sequence: CTG
gccaggctggtctcaaactc

SEQ ID NO: 16589 - DNA, 20 bp, Artificial Sequence
  Description of Artificial Sequence: Synthetic oligonucleotide
  Target: SOD1; (+) strand; PAM type: YTN; PAM sequence: CTG
gtctcaaactcctgacctca

SEQ ID NO: 16590 - DNA, 20 bp, Artificial Sequence
  Description of Artificial Sequence: Synthetic oligonucleotide
  Target: SOD1; (+) strand; PAM type: YTN; PAM sequence: CTC
aaactcctgacctcagatga

SEQ ID NO: 16591 - DNA, 20 bp, Artificial Sequence
  Description of Artificial Sequence: Synthetic oligonucleotide
  Target: SOD1; (+) strand; PAM type: YTN; PAM sequence: CTC
ctgacctcagatgatccagc

SEQ ID NO: 16592 - DNA, 20 bp, Artificial Sequence
  Description of Artificial Sequence: Synthetic oligonucleotide
  Target: SOD1; (+) strand; PAM type: YTN; PAM sequence: CTG
acctcagatgatccagccac

SEQ ID NO: 16593 - DNA, 20 bp, Artificial Sequence
  Description of Artificial Sequence: Synthetic oligonucleotide
  Target: SOD1; (+) strand; PAM type: YTN; PAM sequence: CTC
agatgatccagccacctcag

SEQ ID NO: 16594 - DNA, 20 bp, Artificial Sequence
  Description of Artificial Sequence: Synthetic oligonucleotide
  Target: SOD1; (+) strand; PAM type: YTN; PAM sequence: CTC
agcttcccaaagtgctgggg

SEQ ID NO: 16595 - DNA, 20 bp, Artificial Sequence
  Description of Artificial Sequence: Synthetic oligonucleotide
  Target: SOD1; (+) strand; PAM type: YTN; PAM sequence: CTT
cccaaagtgctggggttcca

SEQ ID NO: 16596 - DNA, 20 bp, Artificial Sequence
  Description of Artificial Sequence: Synthetic oligonucleotide
  Target: SOD1; (+) strand; PAM type: YTN; PAM sequence: TTC
ccaaagtgctggggttccag

SEQ ID NO: 16597 - DNA, 20 bp, Artificial Sequence
  Description of Artificial Sequence: Synthetic oligonucleotide
  Target: SOD1; (+) strand; PAM type: YTN; PAM sequence: CTG
gggttccaggtgttagccac

SEQ ID NO: 16598 - DNA, 20 bp, Artificial Sequence
  Description of Artificial Sequence: Synthetic oligonucleotide
  Target: SOD1; (+) strand; PAM type: YTN; PAM sequence: TTC
caggtgttagccaccatgcc

SEQ ID NO: 16599 - DNA, 20 bp, Artificial Sequence
  Description of Artificial Sequence: Synthetic oligonucleotide
  Target: SOD1; (+) strand; PAM type: YTN; PAM sequence: TTA
gccaccatgcctggccatag

SEQ ID NO: 16600 - DNA, 20 bp, Artificial Sequence
  Description of Artificial Sequence: Synthetic oligonucleotide
  Target: SOD1; (+) strand; PAM type: YTN; PAM sequence: CTG
gccatagacttgtttctgtt

SEQ ID NO: 16601 - DNA, 20 bp, Artificial Sequence
  Description of Artificial Sequence: Synthetic oligonucleotide
  Target: SOD1; (+) strand; PAM type: YTN; PAM sequence: CTT
gtttctgttcccttctcact

SEQ ID NO: 16602 - DNA, 20 bp, Artificial Sequence
  Description of Artificial Sequence: Synthetic oligonucleotide
  Target: SOD1; (+) strand; PAM type: YTN; PAM sequence: TTG
tttctgttcccttctcactg

SEQ ID NO: 16603 - DNA, 20 bp, Artificial Sequence
  Description of Artificial Sequence: Synthetic oligonucleotide
  Target: SOD1; (+) strand; PAM type: YTN; PAM sequence: TTT
ctgttcccttctcactgtgg

SEQ ID NO: 16604 - DNA, 20 bp, Artificial Sequence
  Description of Artificial Sequence: Synthetic oligonucleotide
  Target: SOD1; (+) strand; PAM type: YTN; PAM sequence: TTC
tgttcccttctcactgtggc

SEQ ID NO: 16605 - DNA, 20 bp, Artificial Sequence
  Description of Artificial Sequence: Synthetic oligonucleotide
  Target: SOD1; (+) strand; PAM type: YTN; PAM sequence: CTG
ttcccttctcactgtggctg

SEQ ID NO: 16606 - DNA, 20 bp, Artificial Sequence
  Description of Artificial Sequence: Synthetic oligonucleotide
  Target: SOD1; (+) strand; PAM type: YTN; PAM sequence: TTC
ccttctcactgtggctgtac

SEQ ID NO: 16607 - DNA, 20 bp, Artificial Sequence
  Description of Artificial Sequence: Synthetic oligonucleotide
  Target: SOD1; (+) strand; PAM type: YTN; PAM sequence: CTT
ctcactgtggctgtaccaag

SEQ ID NO: 16608 - DNA, 20 bp, Artificial Sequence
  Description of Artificial Sequence: Synthetic oligonucleotide
  Target: SOD1; (+) strand; PAM type: YTN; PAM sequence: TTC
tcactgtggctgtaccaagg

SEQ ID NO: 16609 - DNA, 20 bp, Artificial Sequence
  Description of Artificial Sequence: Synthetic oligonucleotide
  Target: SOD1; (+) strand; PAM type: YTN; PAM sequence: CTC
actgtggctgtaccaaggtg

SEQ ID NO: 16610 - DNA, 20 bp, Artificial Sequence
  Description of Artificial Sequence: Synthetic oligonucleotide
  Target: SOD1; (+) strand; PAM type: YTN; PAM sequence: CTG
tggctgtaccaaggtgttgc

SEQ ID NO: 16611 - DNA, 20 bp, Artificial Sequence
  Description of Artificial Sequence: Synthetic oligonucleotide
  Target: SOD1; (+) strand; PAM type: YTN; PAM sequence: CTG
taccaaggtgttgcttatcc

SEQ ID NO: 16612 - DNA, 20 bp, Artificial Sequence
  Description of Artificial Sequence: Synthetic oligonucleotide
  Target: SOD1; (+) strand; PAM type: YTN; PAM sequence: TTG
cttatcccagaagtcgtgat

SEQ ID NO: 16613 - DNA, 20 bp, Artificial Sequence
  Description of Artificial Sequence: Synthetic oligonucleotide
  Target: SOD1; (+) strand; PAM type: YTN; PAM sequence: CTT
atcccagaagtcgtgatgca

SEQ ID NO: 16614 - DNA, 20 bp, Artificial Sequence
  Description of Artificial Sequence: Synthetic oligonucleotide
  Target: SOD1; (+) strand; PAM type: YTN; PAM sequence: TTA
tcccagaagtcgtgatgcag

SEQ ID NO: 16615 - DNA, 20 bp, Artificial Sequence
  Description of Artificial Sequence: Synthetic oligonucleotide
  Target: SOD1; (+) strand; PAM type: YTN; PAM sequence: CTT
tctccatgggaagttttagc

SEQ ID NO: 16616 - DNA, 20 bp, Artificial Sequence
  Description of Artificial Sequence: Synthetic oligonucleotide
  Target: SOD1; (+) strand; PAM type: YTN; PAM sequence: TTT
ctccatgggaagttttagca

SEQ ID NO: 16617 - DNA, 20 bp, Artificial Sequence
  Description of Artificial Sequence: Synthetic oligonucleotide
  Target: SOD1; (+) strand; PAM type: YTN; PAM sequence: TTC
tccatgggaagttttagcag

SEQ ID NO: 16618 - DNA, 20 bp, Artificial Sequence
  Description of Artificial Sequence: Synthetic oligonucleotide
  Target: SOD1; (+) strand; PAM type: YTN; PAM sequence: CTC
catgggaagttttagcagtg

SEQ ID NO: 16619 - DNA, 20 bp, Artificial Sequence
  Description of Artificial Sequence: Synthetic oligonucleotide
  Target: SOD1; (+) strand; PAM type: YTN; PAM sequence: TTT
tagcagtgtttctttttaga

SEQ ID NO: 16620 - DNA, 20 bp, Artificial Sequence
  Description of Artificial Sequence: Synthetic oligonucleotide
  Target: SOD1; (+) strand; PAM type: YTN; PAM sequence: TTT
agcagtgtttctttttagaa

SEQ ID NO: 16621 - DNA, 20 bp, Artificial Sequence
  Description of Artificial Sequence: Synthetic oligonucleotide
  Target: SOD1; (+) strand; PAM type: YTN; PAM sequence: TTA
gcagtgtttctttttagaat

SEQ ID NO: 16622 - DNA, 20 bp, Artificial Sequence
  Description of Artificial Sequence: Synthetic oligonucleotide
  Target: SOD1; (+) strand; PAM type: YTN; PAM sequence: TTT
ctttttagaatgtatttggg

SEQ ID NO: 16623 - DNA, 20 bp, Artificial Sequence
  Description of Artificial Sequence: Synthetic oligonucleotide
  Target: SOD1; (+) strand; PAM type: YTN; PAM sequence: TTC
tttttagaatgtatttggga

SEQ ID NO: 16624 - DNA, 20 bp, Artificial Sequence
  Description of Artificial Sequence: Synthetic oligonucleotide
  Target: SOD1; (+) strand; PAM type: YTN; PAM sequence: CTT
tttagaatgtatttgggaac

SEQ ID NO: 16625 - DNA, 20 bp, Artificial Sequence
  Description of Artificial Sequence: Synthetic oligonucleotide
  Target: SOD1; (+) strand; PAM type: YTN; PAM sequence: TTT
ttagaatgtatttgggaact

SEQ ID NO: 16626 - DNA, 20 bp, Artificial Sequence
  Description of Artificial Sequence: Synthetic oligonucleotide
  Target: SOD1; (+) strand; PAM type: YTN; PAM sequence: TTT
tagaatgtatttgggaactt

SEQ ID NO: 16627 - DNA, 20 bp, Artificial Sequence
  Description of Artificial Sequence: Synthetic oligonucleotide
  Target: SOD1; (+) strand; PAM type: YTN; PAM sequence: TTT
agaatgtatttgggaacttt

SEQ ID NO: 16628 - DNA, 20 bp, Artificial Sequence
  Description of Artificial Sequence: Synthetic oligonucleotide
  Target: SOD1; (+) strand; PAM type: YTN; PAM sequence: TTA
gaatgtatttgggaacttta

SEQ ID NO: 16629 - DNA, 20 bp, Artificial Sequence
  Description of Artificial Sequence: Synthetic oligonucleotide
  Target: SOD1; (+) strand; PAM type: YTN; PAM sequence: TTT
gggaactttaattcataatt

SEQ ID NO: 16630 - DNA, 20 bp, Artificial Sequence
  Description of Artificial Sequence: Synthetic oligonucleotide
  Target: SOD1; (+) strand; PAM type: YTN; PAM sequence: TTG
ggaactttaattcataattt

SEQ ID NO: 16631 - DNA, 20 bp, Artificial Sequence
  Description of Artificial Sequence: Synthetic oligonucleotide
  Target: SOD1; (+) strand; PAM type: YTN; PAM sequence: CTT
taattcataatttagctttt

SEQ ID NO: 16632 - DNA, 20 bp, Artificial Sequence
  Description of Artificial Sequence: Synthetic oligonucleotide
  Target: SOD1; (+) strand; PAM type: YTN; PAM sequence: TTT
aattcataatttagcttttt

SEQ ID NO: 16633 - DNA, 20 bp, Artificial Sequence
  Description of Artificial Sequence: Synthetic oligonucleotide
  Target: SOD1; (+) strand; PAM type: YTN; PAM sequence: TTA
attcataatttagctttttt

SEQ ID NO: 16634 - DNA, 20 bp, Artificial Sequence
  Description of Artificial Sequence: Synthetic oligonucleotide
  Target: SOD1; (+) strand; PAM type: YTN; PAM sequence: TTC
ataatttagcttttttttct

SEQ ID NO: 16635 - DNA, 20 bp, Artificial Sequence
  Description of Artificial Sequence: Synthetic oligonucleotide
  Target: SOD1; (+) strand; PAM type: YTN; PAM sequence: TTT
agcttttttttcttcttctt

SEQ ID NO: 16636 - DNA, 20 bp, Artificial Sequence
  Description of Artificial Sequence: Synthetic oligonucleotide
  Target: SOD1; (+) strand; PAM type: YTN; PAM sequence: TTA
gcttttttttcttcttctta

SEQ ID NO: 16637 - DNA, 20 bp, Artificial Sequence
  Description of Artificial Sequence: Synthetic oligonucleotide
  Target: SOD1; (+) strand; PAM type: YTN; PAM sequence: CTT
ttttttcttcttcttataaa

SEQ ID NO: 16638 - DNA, 20 bp, Artificial Sequence
  Description of Artificial Sequence: Synthetic oligonucleotide
  Target: SOD1; (+) strand; PAM type: YTN; PAM sequence: TTT
tttttcttcttcttataaat

SEQ ID NO: 16639 - DNA, 20 bp, Artificial Sequence
  Description of Artificial Sequence: Synthetic oligonucleotide
  Target: SOD1; (+) strand; PAM type: YTN; PAM sequence: TTT
ttttcttcttcttataaata

SEQ ID NO: 16640 - DNA, 20 bp, Artificial Sequence
  Description of Artificial Sequence: Synthetic oligonucleotide
  Target: SOD1; (+) strand; PAM type: YTN; PAM sequence: TTT
tttcttcttcttataaatag

SEQ ID NO: 16641 - DNA, 20 bp, Artificial Sequence
  Description of Artificial Sequence: Synthetic oligonucleotide
  Target: SOD1; (+) strand; PAM type: YTN; PAM sequence: TTT
ttcttcttcttataaatagg

SEQ ID NO: 16642 - DNA, 20 bp, Artificial Sequence
  Description of Artificial Sequence: Synthetic oligonucleotide
  Target: SOD1; (+) strand; PAM type: YTN; PAM sequence: TTT
tcttcttcttataaataggc

SEQ ID NO: 16643 - DNA, 20 bp, Artificial Sequence
  Description of Artificial Sequence: Synthetic oligonucleotide
  Target: SOD1; (+) strand; PAM type: YTN; PAM sequence: TTT
cttcttcttataaataggct

SEQ ID NO: 16644 - DNA, 20 bp, Artificial Sequence
  Description of Artificial Sequence: Synthetic oligonucleotide
  Target: SOD1; (+) strand; PAM type: YTN; PAM sequence: TTC
ttcttcttataaataggctg

SEQ ID NO: 16645 - DNA, 20 bp, Artificial Sequence
  Description of Artificial Sequence: Synthetic oligonucleotide
  Target: SOD1; (+) strand; PAM type: YTN; PAM sequence: CTT
cttcttataaataggctgta

SEQ ID NO: 16646 - DNA, 20 bp, Artificial Sequence
  Description of Artificial Sequence: Synthetic oligonucleotide
  Target: SOD1; (+) strand; PAM type: YTN; PAM sequence: TTC
ttcttataaataggctgtac

SEQ ID NO: 16647 - DNA, 20 bp, Artificial Sequence
  Description of Artificial Sequence: Synthetic oligonucleotide
  Target: SOD1; (+) strand; PAM type: YTN; PAM sequence: CTT
cttataaataggctgtacca

SEQ ID NO: 16648 - DNA, 20 bp, Artificial Sequence
  Description of Artificial Sequence: Synthetic oligonucleotide
  Target: SOD1; (+) strand; PAM type: YTN; PAM sequence: TTC
ttataaataggctgtaccag

SEQ ID NO: 16649 - DNA, 20 bp, Artificial Sequence
  Description of Artificial Sequence: Synthetic oligonucleotide
  Target: SOD1; (+) strand; PAM type: YTN; PAM sequence: CTT
ataaataggctgtaccagtg

SEQ ID NO: 16650 - DNA, 20 bp, Artificial Sequence
  Description of Artificial Sequence: Synthetic oligonucleotide
  Target: SOD1; (+) strand; PAM type: YTN; PAM sequence: TTA
taaataggctgtaccagtgc

SEQ ID NO: 16651 - DNA, 20 bp, Artificial Sequence
  Description of Artificial Sequence: Synthetic oligonucleotide
  Target: SOD1; (+) strand; PAM type: YTN; PAM sequence: CTG
taccagtgcaggtcctcact

SEQ ID NO: 16652 - DNA, 20 bp, Artificial Sequence
  Description of Artificial Sequence: Synthetic oligonucleotide
  Target: SOD1; (+) strand; PAM type: YTN; PAM sequence: CTC
actttaatcctctatccaga

SEQ ID NO: 16653 - DNA, 20 bp, Artificial Sequence
  Description of Artificial Sequence: Synthetic oligonucleotide
  Target: SOD1; (+) strand; PAM type: YTN; PAM sequence: CTT
taatcctctatccagaaaac

SEQ ID NO: 16654 - DNA, 20 bp, Artificial Sequence
  Description of Artificial Sequence: Synthetic oligonucleotide
  Target: SOD1; (+) strand; PAM type: YTN; PAM sequence: TTT
aatcctctatccagaaaaca

SEQ ID NO: 16655 - DNA, 20 bp, Artificial Sequence
  Description of Artificial Sequence: Synthetic oligonucleotide
  Target: SOD1; (+) strand; PAM type: YTN; PAM sequence: TTA
atcctctatccagaaaacac

SEQ ID NO: 16656 - DNA, 20 bp, Artificial Sequence
  Description of Artificial Sequence: Synthetic oligonucleotide
  Target: SOD1; (+) strand; PAM type: YTN; PAM sequence: CTC
tatccagaaaacacggtggg

SEQ ID NO: 16657 - DNA, 20 bp, Artificial Sequence
  Description of Artificial Sequence: Synthetic oligonucleotide
  Target: SOD1; (+) strand; PAM type: YTN; PAM sequence: CTA
tccagaaaacacggtgggcc

SEQ ID NO: 16658 - DNA, 20 bp, Artificial Sequence
  Description of Artificial Sequence: Synthetic oligonucleotide
  Target: SOD1; (+) strand; PAM type: YTN; PAM sequence: CTT
aactcttgtaataatggcga

SEQ ID NO: 16659 - DNA, 20 bp, Artificial Sequence
  Description of Artificial Sequence: Synthetic oligonucleotide
  Target: SOD1; (+) strand; PAM type: YTN; PAM sequence: TTA
actcttgtaataatggcgat

SEQ ID NO: 16660 - DNA, 20 bp, Artificial Sequence
  Description of Artificial Sequence: Synthetic oligonucleotide
  Target: SOD1; (+) strand; PAM type: YTN; PAM sequence: CTC
ttgtaataatggcgatagct

SEQ ID NO: 16661 - DNA, 20 bp, Artificial Sequence
  Description of Artificial Sequence: Synthetic oligonucleotide
  Target: SOD1; (+) strand; PAM type: YTN; PAM sequence: CTT
gtaataatggcgatagcttt

SEQ ID NO: 16662 - DNA, 20 bp, Artificial Sequence
  Description of Artificial Sequence: Synthetic oligonucleotide
  Target: SOD1; (+) strand; PAM type: YTN; PAM sequence: TTG
taataatggcgatagctttc

SEQ ID NO: 16663 - DNA, 20 bp, Artificial Sequence
  Description of Artificial Sequence: Synthetic oligonucleotide
  Target: SOD1; (+) strand; PAM type: YTN; PAM sequence: CTT
tctggagttcatatggtata

SEQ ID NO: 16664 - DNA, 20 bp, Artificial Sequence
  Description of Artificial Sequence: Synthetic oligonucleotide
  Target: SOD1; (+) strand; PAM type: YTN; PAM sequence: TTT
ctggagttcatatggtatac

SEQ ID NO: 16665 - DNA, 20 bp, Artificial Sequence
  Description of Artificial Sequence: Synthetic oligonucleotide
  Target: SOD1; (+) strand; PAM type: YTN; PAM sequence: TTC
tggagttcatatggtatact

SEQ ID NO: 16666 - DNA, 20 bp, Artificial Sequence
  Description of Artificial Sequence: Synthetic oligonucleotide
  Target: SOD1; (+) strand; PAM type: YTN; PAM sequence: CTG
gagttcatatggtatactac

SEQ ID NO: 16667 - DNA, 20 bp, Artificial Sequence
  Description of Artificial Sequence: Synthetic oligonucleotide
  Target: SOD1; (+) strand; PAM type: YTN; PAM sequence: TTC
atatggtatactacttgtaa

SEQ ID NO: 16668 - DNA, 20 bp, Artificial Sequence
  Description of Artificial Sequence: Synthetic oligonucleotide
  Target: SOD1; (+) strand; PAM type: YTN; PAM sequence: CTA
cttgtaaatatgtgctaaga

SEQ ID NO: 16669 - DNA, 20 bp, Artificial Sequence
  Description of Artificial Sequence: Synthetic oligonucleotide
  Target: SOD1; (+) strand; PAM type: YTN; PAM sequence: CTT
gtaaatatgtgctaagataa

SEQ ID NO: 16670 - DNA, 20 bp, Artificial Sequence
  Description of Artificial Sequence: Synthetic oligonucleotide
  Target: SOD1; (+) strand; PAM type: YTN; PAM sequence: TTG
taaatatgtgctaagataat

SEQ ID NO: 16671 - DNA, 20 bp, Artificial Sequence
  Description of Artificial Sequence: Synthetic oligonucleotide
  Target: SOD1; (+) strand; PAM type: YTN; PAM sequence: CTA
agataattccgtgtttcccc

SEQ ID NO: 16672 - DNA, 20 bp, Artificial Sequence
  Description of Artificial Sequence: Synthetic oligonucleotide
  Target: SOD1; (+) strand; PAM type: YTN; PAM sequence: TTC
cgtgtttcccccacctttgc

SEQ ID NO: 16673 - DNA, 20 bp, Artificial Sequence
  Description of Artificial Sequence: Synthetic oligonucleotide
  Target: SOD1; (+) strand; PAM type: YTN; PAM sequence: TTT
cccccacctttgcttttgaa

SEQ ID NO: 16674 - DNA, 20 bp, Artificial Sequence
  Description of Artificial Sequence: Synthetic oligonucleotide
  Target: SOD1; (+) strand; PAM type: YTN; PAM sequence: TTC
ccccacctttgcttttgaac

SEQ ID NO: 16675 - DNA, 20 bp, Artificial Sequence
  Description of Artificial Sequence: Synthetic oligonucleotide
  Target: SOD1; (+) strand; PAM type: YTN; PAM sequence: CTT
tgcttttgaacttgctgact

SEQ ID NO: 16676 - DNA, 20 bp, Artificial Sequence
  Description of Artificial Sequence: Synthetic oligonucleotide
  Target: SOD1; (+) strand; PAM type: YTN; PAM sequence: TTT
gcttttgaacttgctgactc

SEQ ID NO: 16677 - DNA, 20 bp, Artificial Sequence
  Description of Artificial Sequence: Synthetic oligonucleotide
  Target: SOD1; (+) strand; PAM type: YTN; PAM sequence: TTG
cttttgaacttgctgactca

SEQ ID NO: 16678 - DNA, 20 bp, Artificial Sequence
  Description of Artificial Sequence: Synthetic oligonucleotide
  Target: SOD1; (+) strand; PAM type: YTN; PAM sequence: CTT
ttgaacttgctgactcatct

SEQ ID NO: 16679 - DNA, 20 bp, Artificial Sequence
  Description of Artificial Sequence: Synthetic oligonucleotide
  Target: SOD1; (+) strand; PAM type: YTN; PAM sequence: TTT
tgaacttgctgactcatcta

SEQ ID NO: 16680 - DNA, 20 bp, Artificial Sequence
  Description of Artificial Sequence: Synthetic oligonucleotide
  Target: SOD1; (+) strand; PAM type: YTN; PAM sequence: TTT
gaacttgctgactcatctaa

SEQ ID NO: 16681 - DNA, 20 bp, Artificial Sequence
  Description of Artificial Sequence: Synthetic oligonucleotide
  Target: SOD1; (+) strand; PAM type: YTN; PAM sequence: TTG
aacttgctgactcatctaaa

SEQ ID NO: 16682 - DNA, 20 bp, Artificial Sequence
  Description of Artificial Sequence: Synthetic oligonucleotide
  Target: SOD1; (+) strand; PAM type: YTN; PAM sequence: CTT
gctgactcatctaaacccct

SEQ ID NO: 16683 - DNA, 20 bp, Artificial Sequence
  Description of Artificial Sequence: Synthetic oligonucleotide
  Target: SOD1; (+) strand; PAM type: YTN; PAM sequence: TTG
ctgactcatctaaacccctg

SEQ ID NO: 16684 - DNA, 20 bp, Artificial Sequence
  Description of Artificial Sequence: Synthetic oligonucleotide
  Target: SOD1; (+) strand; PAM type: YTN; PAM sequence: CTG
actcatctaaacccctgctc

SEQ ID NO: 16685 - DNA, 20 bp, Artificial Sequence
  Description of Artificial Sequence: Synthetic oligonucleotide
  Target: SOD1; (+) strand; PAM type: YTN; PAM sequence: CTC
atctaaacccctgctcccaa

SEQ ID NO: 16686 - DNA, 20 bp, Artificial Sequence
  Description of Artificial Sequence: Synthetic oligonucleotide
  Target: SOD1; (+) strand; PAM type: YTN; PAM sequence: CTA
aacccctgctcccaaatgct

SEQ ID NO: 16687 - DNA, 20 bp, Artificial Sequence
  Description of Artificial Sequence: Synthetic oligonucleotide
  Target: SOD1; (+) strand; PAM type: YTN; PAM sequence: CTG
ctcccaaatgctggaatgct

SEQ ID NO: 16688 - DNA, 20 bp, Artificial Sequence
  Description of Artificial Sequence: Synthetic oligonucleotide
  Target: SOD1; (+) strand; PAM type: YTN; PAM sequence: CTC
ccaaatgctggaatgctttt

SEQ ID NO: 16689 - DNA, 20 bp, Artificial Sequence
  Description of Artificial Sequence: Synthetic oligonucleotide
  Target: SOD1; (+) strand; PAM type: YTN; PAM sequence: CTG
gaatgcttttacttcctggg

SEQ ID NO: 16690 - DNA, 20 bp, Artificial Sequence
  Description of Artificial Sequence: Synthetic oligonucleotide
  Target: SOD1; (+) strand; PAM type: YTN; PAM sequence: CTT
ttacttcctgggcttaaagg

SEQ ID NO: 16691 - DNA, 20 bp, Artificial Sequence
  Description of Artificial Sequence: Synthetic oligonucleotide
  Target: SOD1; (+) strand; PAM type: YTN; PAM sequence: TTT
tacttcctgggcttaaagga

SEQ ID NO: 16692 - DNA, 20 bp, Artificial Sequence
  Description of Artificial Sequence: Synthetic oligonucleotide
  Target: SOD1; (+) strand; PAM type: YTN; PAM sequence: TTT
acttcctgggcttaaaggaa

SEQ ID NO: 16693 - DNA, 20 bp, Artificial Sequence
  Description of Artificial Sequence: Synthetic oligonucleotide
  Target: SOD1; (+) strand; PAM type: YTN; PAM sequence: TTA
cttcctgggcttaaaggaat

SEQ ID NO: 16694 - DNA, 20 bp, Artificial Sequence
  Description of Artificial Sequence: Synthetic oligonucleotide
  Target: SOD1; (+) strand; PAM type: YTN; PAM sequence: CTT
cctgggcttaaaggaattga

SEQ ID NO: 16695 - DNA, 20 bp, Artificial Sequence
  Description of Artificial Sequence: Synthetic oligonucleotide
  Target: SOD1; (+) strand; PAM type: YTN; PAM sequence: TTC
ctgggcttaaaggaattgac

SEQ ID NO: 16696 - DNA, 20 bp, Artificial Sequence
  Description of Artificial Sequence: Synthetic oligonucleotide
  Target: SOD1; (+) strand; PAM type: YTN; PAM sequence: CTG
ggcttaaaggaattgacaaa

SEQ ID NO: 16697 - DNA, 20 bp, Artificial Sequence
  Description of Artificial Sequence: Synthetic oligonucleotide
  Target: SOD1; (+) strand; PAM type: YTN; PAM sequence: CTT
aaaggaattgacaaatgggg

SEQ ID NO: 16698 - DNA, 20 bp, Artificial Sequence
  Description of Artificial Sequence: Synthetic oligonucleotide
  Target: SOD1; (+) strand; PAM type: YTN; PAM sequence: TTA
aaggaattgacaaatgggga

SEQ ID NO: 16699 - DNA, 20 bp, Artificial Sequence
  Description of Artificial Sequence: Synthetic oligonucleotide
  Target: SOD1; (+) strand; PAM type: YTN; PAM sequence: TTG
acaaatggggacacttaaaa

SEQ ID NO: 16700 - DNA, 20 bp, Artificial Sequence
  Description of Artificial Sequence: Synthetic oligonucleotide
  Target: SOD1; (+) strand; PAM type: YTN; PAM sequence: CTT
aaaacgatttggttttgtag

SEQ ID NO: 16701 - DNA, 20 bp, Artificial Sequence
  Description of Artificial Sequence: Synthetic oligonucleotide
  Target: SOD1; (+) strand; PAM type: YTN; PAM sequence: TTA
aaacgatttggttttgtagc

SEQ ID NO: 16702 - DNA, 20 bp, Artificial Sequence
  Description of Artificial Sequence: Synthetic oligonucleotide
  Target: SOD1; (+) strand; PAM type: YTN; PAM sequence: TTT
ggttttgtagcatttattga

SEQ ID NO: 16703 - DNA, 20 bp, Artificial Sequence
  Description of Artificial Sequence: Synthetic oligonucleotide
  Target: SOD1; (+) strand; PAM type: YTN; PAM sequence: TTG
gttttgtagcatttattgaa

SEQ ID NO: 16704 - DNA, 20 bp, Artificial Sequence
  Description of Artificial Sequence: Synthetic oligonucleotide
  Target: SOD1; (+) strand; PAM type: YTN; PAM sequence: TTT
tgtagcatttattgaatata

SEQ ID NO: 16705 - DNA, 20 bp, Artificial Sequence
  Description of Artificial Sequence: Synthetic oligonucleotide
  Target: SOD1; (+) strand; PAM type: YTN; PAM sequence: TTT
gtagcatttattgaatatag

SEQ ID NO: 16706 - DNA, 20 bp, Artificial Sequence
  Description of Artificial Sequence: Synthetic oligonucleotide
  Target: SOD1; (+) strand; PAM type: YTN; PAM sequence: TTG
tagcatttattgaatataga

SEQ ID NO: 16707 - DNA, 20 bp, Artificial Sequence
  Description of Artificial Sequence: Synthetic oligonucleotide
  Target: SOD1; (+) strand; PAM type: YTN; PAM sequence: TTT
attgaatatagaactaatac

SEQ ID NO: 16708 - DNA, 20 bp, Artificial Sequence
  Description of Artificial Sequence: Synthetic oligonucleotide
  Target: SOD1; (+) strand; PAM type: YTN; PAM sequence: TTA
ttgaatatagaactaataca

SEQ ID NO: 16709 - DNA, 20 bp, Artificial Sequence
  Description of Artificial Sequence: Synthetic oligonucleotide
  Target: SOD1; (+) strand; PAM type: YTN; PAM sequence: TTG
aatatagaactaatacaagt

SEQ ID NO: 16710 - DNA, 20 bp, Artificial Sequence
  Description of Artificial Sequence: Synthetic oligonucleotide
  Target: SOD1; (+) strand; PAM type: YTN; PAM sequence: CTA
atacaagtgccaaaggggaa

SEQ ID NO: 16711 - DNA, 20 bp, Artificial Sequence
  Description of Artificial Sequence: Synthetic oligonucleotide
  Target: SOD1; (+) strand; PAM type: YTN; PAM sequence: CTA
atacaggaaatgtcatgaac

SEQ ID NO: 16712 - DNA, 20 bp, Artificial Sequence
  Description of Artificial Sequence: Synthetic oligonucleotide
  Target: SOD1; (+) strand; PAM type: YTN; PAM sequence: CTG
tcaaccactagcaaaatcaa

SEQ ID NO: 16713 - DNA, 20 bp, Artificial Sequence
  Description of Artificial Sequence: Synthetic oligonucleotide
  Target: SOD1; (+) strand; PAM type: YTN; PAM sequence: CTA
gcaaaatcaatcatcattgt

SEQ ID NO: 16714 - DNA, 20 bp, Artificial Sequence
  Description of Artificial Sequence: Synthetic oligonucleotide
  Target: SOD1; (+) strand; PAM type: YTN; PAM sequence: TTG
tgaaacataggaagcttctg

SEQ ID NO: 16715 - DNA, 20 bp, Artificial Sequence
  Description of Artificial Sequence: Synthetic oligonucleotide
  Target: SOD1; (+) strand; PAM type: YTN; PAM sequence: CTT
ctgtagataaaaaaaaaaat

SEQ ID NO: 16716 - DNA, 20 bp, Artificial Sequence
  Description of Artificial Sequence: Synthetic oligonucleotide
  Target: SOD1; (+) strand; PAM type: YTN; PAM sequence: TTC
tgtagataaaaaaaaaaatt

SEQ ID NO: 16717 - DNA, 20 bp, Artificial Sequence
  Description of Artificial Sequence: Synthetic oligonucleotide
  Target: SOD1; (+) strand; PAM type: YTN; PAM sequence: CTG
tagataaaaaaaaaaattga

SEQ ID NO: 16718 - DNA, 20 bp, Artificial Sequence
  Description of Artificial Sequence: Synthetic oligonucleotide
  Target: SOD1; (+) strand; PAM type: YTN; PAM sequence: TTG
atactgaaaactagtcgaga

SEQ ID NO: 16719 - DNA, 20 bp, Artificial Sequence
  Description of Artificial Sequence: Synthetic oligonucleotide
  Target: SOD1; (+) strand; PAM type: YTN; PAM sequence: CTG
aaaactagtcgagactccat

SEQ ID NO: 16720 - DNA, 20 bp, Artificial Sequence
  Description of Artificial Sequence: Synthetic oligonucleotide
  Target: SOD1; (+) strand; PAM type: YTN; PAM sequence: CTA
gtcgagactccatttatatg

SEQ ID NO: 16721 - DNA, 20 bp, Artificial Sequence
  Description of Artificial Sequence: Synthetic oligonucleotide
  Target: SOD1; (+) strand; PAM type: YTN; PAM sequence: CTC
catttatatgtgtatgtttt

SEQ ID NO: 16722 - DNA, 20 bp, Artificial Sequence
  Description of Artificial Sequence: Synthetic oligonucleotide
  Target: SOD1; (+) strand; PAM type: YTN; PAM sequence: TTT
atatgtgtatgttttctgaa

SEQ ID NO: 16723 - DNA, 20 bp, Artificial Sequence
  Description of Artificial Sequence: Synthetic oligonucleotide
  Target: SOD1; (+) strand; PAM type: YTN; PAM sequence: TTA
tatgtgtatgttttctgaaa

SEQ ID NO: 16724 - DNA, 20 bp, Artificial Sequence
  Description of Artificial Sequence: Synthetic oligonucleotide
  Target: SOD1; (+) strand; PAM type: YTN; PAM sequence: TTT
tctgaaagcctttcagaaaa

SEQ ID NO: 16725 - DNA, 20 bp, Artificial Sequence
  Description of Artificial Sequence: Synthetic oligonucleotide
  Target: SOD1; (+) strand; PAM type: YTN; PAM sequence: TTT
ctgaaagcctttcagaaaaa

SEQ ID NO: 16726 - DNA, 20 bp, Artificial Sequence
  Description of Artificial Sequence: Synthetic oligonucleotide
  Target: SOD1; (+) strand; PAM type: YTN; PAM sequence: TTC
tgaaagcctttcagaaaaat

SEQ ID NO: 16727 - DNA, 20 bp, Artificial Sequence
  Description of Artificial Sequence: Synthetic oligonucleotide
  Target: SOD1; (+) strand; PAM type: YTN; PAM sequence: CTG
aaagcctttcagaaaaatat

SEQ ID NO: 16728 - DNA, 20 bp, Artificial Sequence
  Description of Artificial Sequence: Synthetic oligonucleotide
  Target: SOD1; (+) strand; PAM type: YTN; PAM sequence: CTT
tcagaaaaatattaaattta

SEQ ID NO: 16729 - DNA, 20 bp, Artificial Sequence
  Description of Artificial Sequence: Synthetic oligonucleotide
  Target: SOD1; (+) strand; PAM type: YTN; PAM sequence: TTT
cagaaaaatattaaatttaa

SEQ ID NO: 16730 - DNA, 20 bp, Artificial Sequence
  Description of Artificial Sequence: Synthetic oligonucleotide
  Target: SOD1; (+) strand; PAM type: YTN; PAM sequence: TTC
agaaaaatattaaatttaag

SEQ ID NO: 16731 - DNA, 20 bp, Artificial Sequence
  Description of Artificial Sequence: Synthetic oligonucleotide
  Target: SOD1; (+) strand; PAM type: YTN; PAM sequence: TTA
aatttaaggacaagattttt

SEQ ID NO: 16732 - DNA, 20 bp, Artificial Sequence
  Description of Artificial Sequence: Synthetic oligonucleotide
  Target: SOD1; (+) strand; PAM type: YTN; PAM sequence: TTT
aaggacaagatttttatatc

SEQ ID NO: 16733 - DNA, 20 bp, Artificial Sequence
  Description of Artificial Sequence: Synthetic oligonucleotide
  Target: SOD1; (+) strand; PAM type: YTN; PAM sequence: TTA
aggacaagatttttatatca

SEQ ID NO: 16734 - DNA, 20 bp, Artificial Sequence
  Description of Artificial Sequence: Synthetic oligonucleotide
  Target: SOD1; (+) strand; PAM type: YTN; PAM sequence: TTT
ttatatcagaggccttggga

SEQ ID NO: 16735 - DNA, 20 bp, Artificial Sequence
  Description of Artificial Sequence: Synthetic oligonucleotide
  Target: SOD1; (+) strand; PAM type: YTN; PAM sequence: TTT
tatatcagaggccttgggac

SEQ ID NO: 16736 - DNA, 20 bp, Artificial Sequence
  Description of Artificial Sequence: Synthetic oligonucleotide
  Target: SOD1; (+) strand; PAM type: YTN; PAM sequence: TTT
atatcagaggccttgggaca

SEQ ID NO: 16737 - DNA, 20 bp, Artificial Sequence
  Description of Artificial Sequence: Synthetic oligonucleotide
  Target: SOD1; (+) strand; PAM type: YTN; PAM sequence: TTA
tatcagaggccttgggacat

SEQ ID NO: 16738 - DNA, 20 bp, Artificial Sequence
  Description of Artificial Sequence: Synthetic oligonucleotide
  Target: SOD1; (+) strand; PAM type: YTN; PAM sequence: CTT
gggacatagctttgttagct

SEQ ID NO: 16739 - DNA, 20 bp, Artificial Sequence
  Description of Artificial Sequence: Synthetic oligonucleotide
  Target: SOD1; (+) strand; PAM type: YTN; PAM sequence: TTG
ggacatagctttgttagcta

SEQ ID NO: 16740 - DNA, 20 bp, Artificial Sequence
  Description of Artificial Sequence: Synthetic oligonucleotide
  Target: SOD1; (+) strand; PAM type: YTN; PAM sequence: CTT
tgttagctatgccagtaatt

SEQ ID NO: 16741 - DNA, 20 bp, Artificial Sequence
  Description of Artificial Sequence: Synthetic oligonucleotide
  Target: SOD1; (+) strand; PAM type: YTN; PAM sequence: TTT
gttagctatgccagtaatta

SEQ ID NO: 16742 - DNA, 20 bp, Artificial Sequence
  Description of Artificial Sequence: Synthetic oligonucleotide
  Target: SOD1; (+) strand; PAM type: YTN; PAM sequence: TTG
ttagctatgccagtaattaa

SEQ ID NO: 16743 - DNA, 20 bp, Artificial Sequence
  Description of Artificial Sequence: Synthetic oligonucleotide
  Target: SOD1; (+) strand; PAM type: YTN; PAM sequence: TTA
gctatgccagtaattaacag

SEQ ID NO: 16744 - DNA, 20 bp, Artificial Sequence
  Description of Artificial Sequence: Synthetic oligonucleotide
  Target: SOD1; (+) strand; PAM type: YTN; PAM sequence: CTA
tgccagtaattaacaggcat

SEQ ID NO: 16745 - DNA, 20 bp, Artificial Sequence
  Description of Artificial Sequence: Synthetic oligonucleotide
  Target: SOD1; (+) strand; PAM type: YTN; PAM sequence: TTA
acaggcataactcagtaact

SEQ ID NO: 16746 - DNA, 20 bp, Artificial Sequence
  Description of Artificial Sequence: Synthetic oligonucleotide
  Target: SOD1; (+) strand; PAM type: YTN; PAM sequence: CTC
agtaactgagagtttaccct

SEQ ID NO: 16747 - DNA, 20 bp, Artificial Sequence
  Description of Artificial Sequence: Synthetic oligonucleotide
  Target: SOD1; (+) strand; PAM type: YTN; PAM sequence: CTG
agagtttaccctttggtact

SEQ ID NO: 16748 - DNA, 20 bp, Artificial Sequence
  Description of Artificial Sequence: Synthetic oligonucleotide
  Target: SOD1; (+) strand; PAM type: YTN; PAM sequence: TTT
accctttggtacttctgaaa

SEQ ID NO: 16749 - DNA, 20 bp, Artificial Sequence
  Description of Artificial Sequence: Synthetic oligonucleotide
  Target: SOD1; (+) strand; PAM type: YTN; PAM sequence: TTA
ccctttggtacttctgaaat

SEQ ID NO: 16750 - DNA, 20 bp, Artificial Sequence
  Description of Artificial Sequence: Synthetic oligonucleotide
  Target: SOD1; (+) strand; PAM type: YTN; PAM sequence: CTT
tggtacttctgaaatcaggt

SEQ ID NO: 16751 - DNA, 20 bp, Artificial Sequence
  Description of Artificial Sequence: Synthetic oligonucleotide
  Target: SOD1; (+) strand; PAM type: YTN; PAM sequence: TTT
ggtacttctgaaatcaggtg

SEQ ID NO: 16752 - DNA, 20 bp, Artificial Sequence
  Description of Artificial Sequence: Synthetic oligonucleotide
  Target: SOD1; (+) strand; PAM type: YTN; PAM sequence: TTG
gtacttctgaaatcaggtgc

SEQ ID NO: 16753 - DNA, 20 bp, Artificial Sequence
  Description of Artificial Sequence: Synthetic oligonucleotide
  Target: SOD1; (+) strand; PAM type: YTN; PAM sequence: CTT
ctgaaatcaggtgcagcccc

SEQ ID NO: 16754 - DNA, 20 bp, Artificial Sequence
  Description of Artificial Sequence: Synthetic oligonucleotide
  Target: SOD1; (+) strand; PAM type: YTN; PAM sequence: TTC
tgaaatcaggtgcagcccca

SEQ ID NO: 16755 - DNA, 20 bp, Artificial Sequence
  Description of Artificial Sequence: Synthetic oligonucleotide
  Target: SOD1; (+) strand; PAM type: YTN; PAM sequence: CTG
aaatcaggtgcagccccatc

SEQ ID NO: 16756 - DNA, 20 bp, Artificial Sequence
  Description of Artificial Sequence: Synthetic oligonucleotide
  Target: SOD1; (+) strand; PAM type: YTN; PAM sequence: CTT
tcttcccagagcattagtgt

SEQ ID NO: 16757 - DNA, 20 bp, Artificial Sequence
  Description of Artificial Sequence: Synthetic oligonucleotide
  Target: SOD1; (+) strand; PAM type: YTN; PAM sequence: TTT
cttcccagagcattagtgtg

SEQ ID NO: 16758 - DNA, 20 bp, Artificial Sequence
  Description of Artificial Sequence: Synthetic oligonucleotide
  Target: SOD1; (+) strand; PAM type: YTN; PAM sequence: TTC
ttcccagagcattagtgtgt

SEQ ID NO: 16759 - DNA, 20 bp, Artificial Sequence
  Description of Artificial Sequence: Synthetic oligonucleotide
  Target: SOD1; (+) strand; PAM type: YTN; PAM sequence: CTT
cccagagcattagtgtgtag

SEQ ID NO: 16760 - DNA, 20 bp, Artificial Sequence
  Description of Artificial Sequence: Synthetic oligonucleotide
  Target: SOD1; (+) strand; PAM type: YTN; PAM sequence: TTC
ccagagcattagtgtgtaga

SEQ ID NO: 16761 - DNA, 20 bp, Artificial Sequence
  Description of Artificial Sequence: Synthetic oligonucleotide
  Target: SOD1; (+) strand; PAM type: YTN; PAM sequence: TTA
gtgtgtagacgtgaagcctt

SEQ ID NO: 16762 - DNA, 20 bp, Artificial Sequence
  Description of Artificial Sequence: Synthetic oligonucleotide
  Target: SOD1; (+) strand; PAM type: YTN; PAM sequence: CTT
gtttgaagagctgtatttag

SEQ ID NO: 16763 - DNA, 20 bp, Artificial Sequence
  Description of Artificial Sequence: Synthetic oligonucleotide
  Target: SOD1; (+) strand; PAM type: YTN; PAM sequence: TTG
tttgaagagctgtatttaga

SEQ ID NO: 16764 - DNA, 20 bp, Artificial Sequence
  Description of Artificial Sequence: Synthetic oligonucleotide
  Target: SOD1; (+) strand; PAM type: YTN; PAM sequence: TTT
gaagagctgtatttagaatg

SEQ ID NO: 16765 - DNA, 20 bp, Artificial Sequence
  Description of Artificial Sequence: Synthetic oligonucleotide
  Target: SOD1; (+) strand; PAM type: YTN; PAM sequence: TTG
aagagctgtatttagaatgc

SEQ ID NO: 16766 - DNA, 20 bp, Artificial Sequence
  Description of Artificial Sequence: Synthetic oligonucleotide
  Target: SOD1; (+) strand; PAM type: YTN; PAM sequence: CTG
tatttagaatgcctagctac

SEQ ID NO: 16767 - DNA, 20 bp, Artificial Sequence
  Description of Artificial Sequence: Synthetic oligonucleotide
  Target: SOD1; (+) strand; PAM type: YTN; PAM sequence: TTT
agaatgcctagctacttgtt

SEQ ID NO: 16768 - DNA, 20 bp, Artificial Sequence
  Description of Artificial Sequence: Synthetic oligonucleotide
  Target: SOD1; (+) strand; PAM type: YTN; PAM sequence: TTA
gaatgcctagctacttgttt

SEQ ID NO: 16769 - DNA, 20 bp, Artificial Sequence
  Description of Artificial Sequence: Synthetic oligonucleotide
  Target: SOD1; (+) strand; PAM type: YTN; PAM sequence: CTA
gctacttgtttgcaaatttg

SEQ ID NO: 16770 - DNA, 20 bp, Artificial Sequence
  Description of Artificial Sequence: Synthetic oligonucleotide
  Target: SOD1; (+) strand; PAM type: YTN; PAM sequence: CTA
cttgtttgcaaatttgtgtc

SEQ ID NO: 16771 - DNA, 20 bp, Artificial Sequence
  Description of Artificial Sequence: Synthetic oligonucleotide
  Target: SOD1; (+) strand; PAM type: YTN; PAM sequence: CTT
gtttgcaaatttgtgtctac

SEQ ID NO: 16772 - DNA, 20 bp, Artificial Sequence
  Description of Artificial Sequence: Synthetic oligonucleotide
  Target: SOD1; (+) strand; PAM type: YTN; PAM sequence: TTG
tttgcaaatttgtgtctact

SEQ ID NO: 16773 - DNA, 20 bp, Artificial Sequence
  Description of Artificial Sequence: Synthetic oligonucleotide
  Target: SOD1; (+) strand; PAM type: YTN; PAM sequence: TTT
gcaaatttgtgtctactcag

SEQ ID NO: 16774 - DNA, 20 bp, Artificial Sequence
  Description of Artificial Sequence: Synthetic oligonucleotide
  Target: SOD1; (+) strand; PAM type: YTN; PAM sequence: TTG
caaatttgtgtctactcagt

SEQ ID NO: 16775 - DNA, 20 bp, Artificial Sequence
  Description of Artificial Sequence: Synthetic oligonucleotide
  Target: SOD1; (+) strand; PAM type: YTN; PAM sequence: TTT
gtgtctactcagtcaagttt

SEQ ID NO: 16776 - DNA, 20 bp, Artificial Sequence
  Description of Artificial Sequence: Synthetic oligonucleotide
  Target: SOD1; (+) strand; PAM type: YTN; PAM sequence: TTG
tgtctactcagtcaagtttt

SEQ ID NO: 16777 - DNA, 20 bp, Artificial Sequence
  Description of Artificial Sequence: Synthetic oligonucleotide
  Target: SOD1; (+) strand; PAM type: YTN; PAM sequence: CTA
ctcagtcaagttttaattta

SEQ ID NO: 16778 - DNA, 20 bp, Artificial Sequence
  Description of Artificial Sequence: Synthetic oligonucleotide
  Target: SOD1; (+) strand; PAM type: YTN; PAM sequence: CTC
agtcaagttttaatttagct

SEQ ID NO: 16779 - DNA, 20 bp, Artificial Sequence
  Description of Artificial Sequence: Synthetic oligonucleotide
  Target: SOD1; (+) strand; PAM type: YTN; PAM sequence: TTT
taatttagctcatgaactac

SEQ ID NO: 16780 - DNA, 20 bp, Artificial Sequence
  Description of Artificial Sequence: Synthetic oligonucleotide
  Target: SOD1; (+) strand; PAM type: YTN; PAM sequence: TTT
aatttagctcatgaactacc

SEQ ID NO: 16781 - DNA, 20 bp, Artificial Sequence
  Description of Artificial Sequence: Synthetic oligonucleotide
  Target: SOD1; (+) strand; PAM type: YTN; PAM sequence: TTA
atttagctcatgaactacct

SEQ ID NO: 16782 - DNA, 20 bp, Artificial Sequence
  Description of Artificial Sequence: Synthetic oligonucleotide
  Target: SOD1; (+) strand; PAM type: YTN; PAM sequence: TTT
agctcatgaactaccttgat

SEQ ID NO: 16783 - DNA, 20 bp, Artificial Sequence
  Description of Artificial Sequence: Synthetic oligonucleotide
  Target: SOD1; (+) strand; PAM type: YTN; PAM sequence: TTA
gctcatgaactaccttgatg

SEQ ID NO: 16784 - DNA, 20 bp, Artificial Sequence
  Description of Artificial Sequence: Synthetic oligonucleotide
  Target: SOD1; (+) strand; PAM type: YTN; PAM sequence: CTC
atgaactaccttgatgttta

SEQ ID NO: 16785 - DNA, 20 bp, Artificial Sequence
  Description of Artificial Sequence: Synthetic oligonucleotide
  Target: SOD1; (+) strand; PAM type: YTN; PAM sequence: CTA
ccttgatgtttagtggcatc

SEQ ID NO: 16786 - DNA, 20 bp, Artificial Sequence
  Description of Artificial Sequence: Synthetic oligonucleotide
  Target: SOD1; (+) strand; PAM type: YTN; PAM sequence: CTT
gatgtttagtggcatcagcc

SEQ ID NO: 16787 - DNA, 20 bp, Artificial Sequence
  Description of Artificial Sequence: Synthetic oligonucleotide
  Target: SOD1; (+) strand; PAM type: YTN; PAM sequence: TTG
atgtttagtggcatcagccc

SEQ ID NO: 16788 - DNA, 20 bp, Artificial Sequence
  Description of Artificial Sequence: Synthetic oligonucleotide
  Target: SOD1; (+) strand; PAM type: YTN; PAM sequence: TTT
agtggcatcagccctaatcc

SEQ ID NO: 16789 - DNA, 20 bp, Artificial Sequence
  Description of Artificial Sequence: Synthetic oligonucleotide
  Target: SOD1; (+) strand; PAM type: YTN; PAM sequence: TTA
gtggcatcagccctaatcca

SEQ ID NO: 16790 - DNA, 20 bp, Artificial Sequence
  Description of Artificial Sequence: Synthetic oligonucleotide
  Target: SOD1; (+) strand; PAM type: YTN; PAM sequence: CTA
atccatctgatgctttttca

SEQ ID NO: 16791 - DNA, 20 bp, Artificial Sequence
  Description of Artificial Sequence: Synthetic oligonucleotide
  Target: SOD1; (+) strand; PAM type: YTN; PAM sequence: CTG
atgctttttcattattaggc

SEQ ID NO: 16792 - DNA, 20 bp, Artificial Sequence
  Description of Artificial Sequence: Synthetic oligonucleotide
  Target: SOD1; (+) strand; PAM type: YTN; PAM sequence: CTT
tttcattattaggcatgttg

SEQ ID NO: 16793 - DNA, 20 bp, Artificial Sequence
  Description of Artificial Sequence: Synthetic oligonucleotide
  Target: SOD1; (+) strand; PAM type: YTN; PAM sequence: TTT
ttcattattaggcatgttgg

SEQ ID NO: 16794 - DNA, 20 bp, Artificial Sequence
  Description of Artificial Sequence: Synthetic oligonucleotide
  Target: SOD1; (+) strand; PAM type: YTN; PAM sequence: TTT
tcattattaggcatgttgga

SEQ ID NO: 16795 - DNA, 20 bp, Artificial Sequence
  Description of Artificial Sequence: Synthetic oligonucleotide
  Target: SOD1; (+) strand; PAM type: YTN; PAM sequence: TTT
cattattaggcatgttggag

SEQ ID NO: 16796 - DNA, 20 bp, Artificial Sequence
  Description of Artificial Sequence: Synthetic oligonucleotide
  Target: SOD1; (+) strand; PAM type: YTN; PAM sequence: TTC
attattaggcatgttggaga

SEQ ID NO: 16797 - DNA, 20 bp, Artificial Sequence
  Description of Artificial Sequence: Synthetic oligonucleotide
  Target: SOD1; (+) strand; PAM type: YTN; PAM sequence: TTA
ttaggcatgttggagacttg

SEQ ID NO: 16798 - DNA, 20 bp, Artificial Sequence
  Description of Artificial Sequence: Synthetic oligonucleotide
  Target: SOD1; (+) strand; PAM type: YTN; PAM sequence: TTA
ggcatgttggagacttgggc

SEQ ID NO: 16799 - DNA, 20 bp, Artificial Sequence
  Description of Artificial Sequence: Synthetic oligonucleotide
  Target: SOD1; (+) strand; PAM type: YTN; PAM sequence: TTG
gagacttgggcaatgtgact

SEQ ID NO: 16800 - DNA, 20 bp, Artificial Sequence
  Description of Artificial Sequence: Synthetic oligonucleotide
  Target: SOD1; (+) strand; PAM type: YTN; PAM sequence: CTT
gggcaatgtgactgctgaca

SEQ ID NO: 16801 - DNA, 20 bp, Artificial Sequence
  Description of Artificial Sequence: Synthetic oligonucleotide
  Target: SOD1; (+) strand; PAM type: YTN; PAM sequence: TTG
ggcaatgtgactgctgacaa

SEQ ID NO: 16802 - DNA, 20 bp, Artificial Sequence
  Description of Artificial Sequence: Synthetic oligonucleotide
  Target: SOD1; (+) strand; PAM type: YTN; PAM sequence: CTG
ctgacaaagatggtgtggcc

SEQ ID NO: 16803 - DNA, 20 bp, Artificial Sequence
  Description of Artificial Sequence: Synthetic oligonucleotide
  Target: SOD1; (+) strand; PAM type: YTN; PAM sequence: CTG
acaaagatggtgtggccgat

SEQ ID NO: 16804 - DNA, 20 bp, Artificial Sequence
  Description of Artificial Sequence: Synthetic oligonucleotide
  Target: SOD1; (+) strand; PAM type: YTN; PAM sequence: CTA
ttgaagattctgtgatctca

SEQ ID NO: 16805 - DNA, 20 bp, Artificial Sequence
  Description of Artificial Sequence: Synthetic oligonucleotide
  Target: SOD1; (+) strand; PAM type: YTN; PAM sequence: TTG
aagattctgtgatctcactc

SEQ ID NO: 16806 - DNA, 20 bp, Artificial Sequence
  Description of Artificial Sequence: Synthetic oligonucleotide
  Target: SOD1; (+) strand; PAM type: YTN; PAM sequence: TTC
tgtgatctcactctcaggag

SEQ ID NO: 16807 - DNA, 20 bp, Artificial Sequence
  Description of Artificial Sequence: Synthetic oligonucleotide
  Target: SOD1; (+) strand; PAM type: YTN; PAM sequence: CTG
tgatctcactctcaggagac

SEQ ID NO: 16808 - DNA, 20 bp, Artificial Sequence
  Description of Artificial Sequence: Synthetic oligonucleotide
  Target: SOD1; (+) strand; PAM type: YTN; PAM sequence: CTC
actctcaggagaccattgca

SEQ ID NO: 16809 - DNA, 20 bp, Artificial Sequence
  Description of Artificial Sequence: Synthetic oligonucleotide
  Target: SOD1; (+) strand; PAM type: YTN; PAM sequence: CTC
tcaggagaccattgcatcat

SEQ ID NO: 16810 - DNA, 20 bp, Artificial Sequence
  Description of Artificial Sequence: Synthetic oligonucleotide
  Target: SOD1; (+) strand; PAM type: YTN; PAM sequence: CTC
aggagaccattgcatcattg

SEQ ID NO: 16811 - DNA, 20 bp, Artificial Sequence
  Description of Artificial Sequence: Synthetic oligonucleotide
  Target: SOD1; (+) strand; PAM type: YTN; PAM sequence: TTG
catcattggccgcacactgg

SEQ ID NO: 16812 - DNA, 20 bp, Artificial Sequence
  Description of Artificial Sequence: Synthetic oligonucleotide
  Target: SOD1; (+) strand; PAM type: YTN; PAM sequence: TTG
gccgcacactggtggtaagt

SEQ ID NO: 16813 - DNA, 20 bp, Artificial Sequence
  Description of Artificial Sequence: Synthetic oligonucleotide
  Target: SOD1; (+) strand; PAM type: YTN; PAM sequence: CTG
gtggtaagttttcataaaag

SEQ ID NO: 16814 - DNA, 20 bp, Artificial Sequence
  Description of Artificial Sequence: Synthetic oligonucleotide
  Target: SOD1; (+) strand; PAM type: YTN; PAM sequence: TTT
tcataaaaggatatgcataa

SEQ ID NO: 16815 - DNA, 20 bp, Artificial Sequence
  Description of Artificial Sequence: Synthetic oligonucleotide
  Target: SOD1; (+) strand; PAM type: YTN; PAM sequence: TTT
cataaaaggatatgcataaa

SEQ ID NO: 16816 - DNA, 20 bp, Artificial Sequence
  Description of Artificial Sequence: Synthetic oligonucleotide
  Target: SOD1; (+) strand; PAM type: YTN; PAM sequence: TTC
ataaaaggatatgcataaaa

SEQ ID NO: 16817 - DNA, 20 bp, Artificial Sequence
  Description of Artificial Sequence: Synthetic oligonucleotide
  Target: SOD1; (+) strand; PAM type: YTN; PAM sequence: CTT
cttctaacatacagtcatgt

SEQ ID NO: 16818 - DNA, 20 bp, Artificial Sequence
  Description of Artificial Sequence: Synthetic oligonucleotide
  Target: SOD1; (+) strand; PAM type: YTN; PAM sequence: TTC
ttctaacatacagtcatgta

SEQ ID NO: 16819 - DNA, 20 bp, Artificial Sequence
  Description of Artificial Sequence: Synthetic oligonucleotide
  Target: SOD1; (+) strand; PAM type: YTN; PAM sequence: CTT
ctaacatacagtcatgtatc

SEQ ID NO: 16820 - DNA, 20 bp, Artificial Sequence
  Description of Artificial Sequence: Synthetic oligonucleotide
  Target: SOD1; (+) strand; PAM type: YTN; PAM sequence: TTC
taacatacagtcatgtatct

SEQ ID NO: 16821 - DNA, 20 bp, Artificial Sequence
  Description of Artificial Sequence: Synthetic oligonucleotide
  Target: SOD1; (+) strand; PAM type: YTN; PAM sequence: CTA
acatacagtcatgtatcttt

SEQ ID NO: 16822 - DNA, 20 bp, Artificial Sequence
  Description of Artificial Sequence: Synthetic oligonucleotide
  Target: SOD1; (+) strand; PAM type: YTN; PAM sequence: CTT
ttcactttgattgttagtcg

SEQ ID NO: 16823 - DNA, 20 bp, Artificial Sequence
  Description of Artificial Sequence: Synthetic oligonucleotide
  Target: SOD1; (+) strand; PAM type: YTN; PAM sequence: TTT
tcactttgattgttagtcgc

SEQ ID NO: 16824 - DNA, 20 bp, Artificial Sequence
  Description of Artificial Sequence: Synthetic oligonucleotide
  Target: SOD1; (+) strand; PAM type: YTN; PAM sequence: TTT
cactttgattgttagtcgcg

SEQ ID NO: 16825 - DNA, 20 bp, Artificial Sequence
  Description of Artificial Sequence: Synthetic oligonucleotide
  Target: SOD1; (+) strand; PAM type: YTN; PAM sequence: TTC
actttgattgttagtcgcgg

SEQ ID NO: 16826 - DNA, 20 bp, Artificial Sequence
  Description of Artificial Sequence: Synthetic oligonucleotide
  Target: SOD1; (+) strand; PAM type: YTN; PAM sequence: CTT
tgattgttagtcgcggtttc

SEQ ID NO: 16827 - DNA, 20 bp, Artificial Sequence
  Description of Artificial Sequence: Synthetic oligonucleotide
  Target: SOD1; (+) strand; PAM type: YTN; PAM sequence: TTT
gattgttagtcgcggtttct

SEQ ID NO: 16828 - DNA, 20 bp, Artificial Sequence
  Description of Artificial Sequence: Synthetic oligonucleotide
  Target: SOD1; (+) strand; PAM type: YTN; PAM sequence: TTG
attgttagtcgcggtttcta

SEQ ID NO: 16829 - DNA, 20 bp, Artificial Sequence
  Description of Artificial Sequence: Synthetic oligonucleotide
  Target: SOD1; (+) strand; PAM type: YTN; PAM sequence: TTG
ttagtcgcggtttctaaaga

SEQ ID NO: 16830 - DNA, 20 bp, Artificial Sequence
  Description of Artificial Sequence: Synthetic oligonucleotide
  Target: SOD1; (+) strand; PAM type: YTN; PAM sequence: TTA
gtcgcggtttctaaagatcc

SEQ ID NO: 16831 - DNA, 20 bp, Artificial Sequence
  Description of Artificial Sequence: Synthetic oligonucleotide
  Target: SOD1; (+) strand; PAM type: YTN; PAM sequence: TTT
ctaaagatccagataaactg

SEQ ID NO: 16832 - DNA, 20 bp, Artificial Sequence
  Description of Artificial Sequence: Synthetic oligonucleotide
  Target: SOD1; (+) strand; PAM type: YTN; PAM sequence: TTC
taaagatccagataaactgt

SEQ ID NO: 16833 - DNA, 20 bp, Artificial Sequence
  Description of Artificial Sequence: Synthetic oligonucleotide
  Target: SOD1; (+) strand; PAM type: YTN; PAM sequence: CTA
aagatccagataaactgtac

SEQ ID NO: 16834 - DNA, 20 bp, Artificial Sequence
  Description of Artificial Sequence: Synthetic oligonucleotide
  Target: SOD1; (+) strand; PAM type: YTN; PAM sequence: CTG
tacttgcagttcaaattagg

SEQ ID NO: 16835 - DNA, 20 bp, Artificial Sequence
  Description of Artificial Sequence: Synthetic oligonucleotide
  Target: SOD1; (+) strand; PAM type: YTN; PAM sequence: CTT
gcagttcaaattaggaaaag

SEQ ID NO: 16836 - DNA, 20 bp, Artificial Sequence
  Description of Artificial Sequence: Synthetic oligonucleotide
  Target: SOD1; (+) strand; PAM type: YTN; PAM sequence: TTG
cagttcaaattaggaaaagc

SEQ ID NO: 16837 - DNA, 20 bp, Artificial Sequence
  Description of Artificial Sequence: Synthetic oligonucleotide
  Target: SOD1; (+) strand; PAM type: YTN; PAM sequence: TTC
aaattaggaaaagcaatttt

SEQ ID NO: 16838 - DNA, 20 bp, Artificial Sequence
  Description of Artificial Sequence: Synthetic oligonucleotide
  Target: SOD1; (+) strand; PAM type: YTN; PAM sequence: TTA
ggaaaagcaattttattgga

SEQ ID NO: 16839 - DNA, 20 bp, Artificial Sequence
  Description of Artificial Sequence: Synthetic oligonucleotide
  Target: SOD1; (+) strand; PAM type: YTN; PAM sequence: TTT
tattggacaattacggtgaa

SEQ ID NO: 16840 - DNA, 20 bp, Artificial Sequence
  Description of Artificial Sequence: Synthetic oligonucleotide
  Target: SOD1; (+) strand; PAM type: YTN; PAM sequence: TTT
attggacaattacggtgaaa

SEQ ID NO: 16841 - DNA, 20 bp, Artificial Sequence
  Description of Artificial Sequence: Synthetic oligonucleotide
  Target: SOD1; (+) strand; PAM type: YTN; PAM sequence: TTA
ttggacaattacggtgaaaa

SEQ ID NO: 16842 - DNA, 20 bp, Artificial Sequence
  Description of Artificial Sequence: Synthetic oligonucleotide
  Target: SOD1; (+) strand; PAM type: YTN; PAM sequence: TTG
gacaattacggtgaaaatga

SEQ ID NO: 16843 - DNA, 20 bp, Artificial Sequence
  Description of Artificial Sequence: Synthetic oligonucleotide
  Target: SOD1; (+) strand; PAM type: YTN; PAM sequence: TTA
cggtgaaaatgaattatttt

SEQ ID NO: 16844 - DNA, 20 bp, Artificial Sequence
  Description of Artificial Sequence: Synthetic oligonucleotide
  Target: SOD1; (+) strand; PAM type: YTN; PAM sequence: TTA
ttttatctaggtcagttaag

SEQ ID NO: 16845 - DNA, 20 bp, Artificial Sequence
  Description of Artificial Sequence: Synthetic oligonucleotide
  Target: SOD1; (+) strand; PAM type: YTN; PAM sequence: TTT
tatctaggtcagttaagaac

SEQ ID NO: 16846 - DNA, 20 bp, Artificial Sequence
  Description of Artificial Sequence: Synthetic oligonucleotide
  Target: SOD1; (+) strand; PAM type: YTN; PAM sequence: TTT
atctaggtcagttaagaaca

SEQ ID NO: 16847 - DNA, 20 bp, Artificial Sequence
  Description of Artificial Sequence: Synthetic oligonucleotide
  Target: SOD1; (+) strand; PAM type: YTN; PAM sequence: TTA
tctaggtcagttaagaacac

SEQ ID NO: 16848 - DNA, 20 bp, Artificial Sequence
  Description of Artificial Sequence: Synthetic oligonucleotide
  Target: SOD1; (+) strand; PAM type: YTN; PAM sequence: CTA
ggtcagttaagaacactgtt

SEQ ID NO: 16849 - DNA, 20 bp, Artificial Sequence
  Description of Artificial Sequence: Synthetic oligonucleotide
  Target: SOD1; (+) strand; PAM type: YTN; PAM sequence: TTA
agaacactgttctgctaaga

SEQ ID NO: 16850 - DNA, 20 bp, Artificial Sequence
  Description of Artificial Sequence: Synthetic oligonucleotide
  Target: SOD1; (+) strand; PAM type: YTN; PAM sequence: CTG
ttctgctaagatgcagtaaa

SEQ ID NO: 16851 - DNA, 20 bp, Artificial Sequence
  Description of Artificial Sequence: Synthetic oligonucleotide
  Target: SOD1; (+) strand; PAM type: YTN; PAM sequence: TTC
tgctaagatgcagtaaaaag

SEQ ID NO: 16852 - DNA, 20 bp, Artificial Sequence
  Description of Artificial Sequence: Synthetic oligonucleotide
  Target: SOD1; (+) strand; PAM type: YTN; PAM sequence: CTG
ctaagatgcagtaaaaagca

SEQ ID NO: 16853 - DNA, 20 bp, Artificial Sequence
  Description of Artificial Sequence: Synthetic oligonucleotide
  Target: SOD1; (+) strand; PAM type: YTN; PAM sequence: CTA
agatgcagtaaaaagcaggt

SEQ ID NO: 16854 - DNA, 20 bp, Artificial Sequence
  Description of Artificial Sequence: Synthetic oligonucleotide
  Target: SOD1; (+) strand; PAM type: YTN; PAM sequence: TTA
catttgaccatattagatct

SEQ ID NO: 16855 - DNA, 20 bp, Artificial Sequence
  Description of Artificial Sequence: Synthetic oligonucleotide
  Target: SOD1; (+) strand; PAM type: YTN; PAM sequence: TTT
gaccatattagatctgagtt

SEQ ID NO: 16856 - DNA, 20 bp, Artificial Sequence
  Description of Artificial Sequence: Synthetic oligonucleotide
  Target: SOD1; (+) strand; PAM type: YTN; PAM sequence: TTG
accatattagatctgagttt

SEQ ID NO: 16857 - DNA, 20 bp, Artificial Sequence
  Description of Artificial Sequence: Synthetic oligonucleotide
  Target: SOD1; (+) strand; PAM type: YTN; PAM sequence: TTA
gatctgagtttggaaaacag

SEQ ID NO: 16858 - DNA, 20 bp, Artificial Sequence
  Description of Artificial Sequence: Synthetic oligonucleotide
  Target: SOD1; (+) strand; PAM type: YTN; PAM sequence: CTG
agtttggaaaacagaagtag

SEQ ID NO: 16859 - DNA, 20 bp, Artificial Sequence
  Description of Artificial Sequence: Synthetic oligonucleotide
  Target: SOD1; (+) strand; PAM type: YTN; PAM sequence: TTT
ggaaaacagaagtagtcttt

SEQ ID NO: 16860 - DNA, 20 bp, Artificial Sequence
  Description of Artificial Sequence: Synthetic oligonucleotide
  Target: SOD1; (+) strand; PAM type: YTN; PAM sequence: TTG
gaaaacagaagtagtcttta

SEQ ID NO: 16861 - DNA, 20 bp, Artificial Sequence
  Description of Artificial Sequence: Synthetic oligonucleotide
  Target: SOD1; (+) strand; PAM type: YTN; PAM sequence: CTT
tagttttaaaatggccagat

SEQ ID NO: 16862 - DNA, 20 bp, Artificial Sequence
  Description of Artificial Sequence: Synthetic oligonucleotide
  Target: SOD1; (+) strand; PAM type: YTN; PAM sequence: TTT
agttttaaaatggccagatt

SEQ ID NO: 16863 - DNA, 20 bp, Artificial Sequence
  Description of Artificial Sequence: Synthetic oligonucleotide
  Target: SOD1; (+) strand; PAM type: YTN; PAM sequence: TTA
gttttaaaatggccagattt

SEQ ID NO: 16864 - DNA, 20 bp, Artificial Sequence
  Description of Artificial Sequence: Synthetic oligonucleotide
  Target: SOD1; (+) strand; PAM type: YTN; PAM sequence: TTT
taaaatggccagattttctt

SEQ ID NO: 16865 - DNA, 20 bp, Artificial Sequence
  Description of Artificial Sequence: Synthetic oligonucleotide
  Target: SOD1; (+) strand; PAM type: YTN; PAM sequence: TTT
aaaatggccagattttcttg

SEQ ID NO: 16866 - DNA, 20 bp, Artificial Sequence
  Description of Artificial Sequence: Synthetic oligonucleotide
  Target: SOD1; (+) strand; PAM type: YTN; PAM sequence: TTA
aaatggccagattttcttgc

SEQ ID NO: 16867 - DNA, 20 bp, Artificial Sequence
  Description of Artificial Sequence: Synthetic oligonucleotide
  Target: SOD1; (+) strand; PAM type: YTN; PAM sequence: TTT
tcttgccaggattgggtttc

SEQ ID NO: 16868 - DNA, 20 bp, Artificial Sequence
  Description of Artificial Sequence: Synthetic oligonucleotide
  Target: SOD1; (+) strand; PAM type: YTN; PAM sequence: TTT
cttgccaggattgggtttct

SEQ ID NO: 16869 - DNA, 20 bp, Artificial Sequence
  Description of Artificial Sequence: Synthetic oligonucleotide
  Target: SOD1; (+) strand; PAM type: YTN; PAM sequence: TTC
ttgccaggattgggtttctc

SEQ ID NO: 16870 - DNA, 20 bp, Artificial Sequence
  Description of Artificial Sequence: Synthetic oligonucleotide
  Target: SOD1; (+) strand; PAM type: YTN; PAM sequence: CTT
gccaggattgggtttctcac

SEQ ID NO: 16871 - DNA, 20 bp, Artificial Sequence
  Description of Artificial Sequence: Synthetic oligonucleotide
  Target: SOD1; (+) strand; PAM type: YTN; PAM sequence: TTG
ccaggattgggtttctcact

SEQ ID NO: 16872 - DNA, 20 bp, Artificial Sequence
  Description of Artificial Sequence: Synthetic oligonucleotide
  Target: SOD1; (+) strand; PAM type: YTN; PAM sequence: TTG
ggtttctcacttgttaaaca

SEQ ID NO: 16873 - DNA, 20 bp, Artificial Sequence
  Description of Artificial Sequence: Synthetic oligonucleotide
  Target: SOD1; (+) strand; PAM type: YTN; PAM sequence: TTT
ctcacttgttaaacagaaca

SEQ ID NO: 16874 - DNA, 20 bp, Artificial Sequence
  Description of Artificial Sequence: Synthetic oligonucleotide
  Target: SOD1; (+) strand; PAM type: YTN; PAM sequence: TTC
tcacttgttaaacagaacat

SEQ ID NO: 16875 - DNA, 20 bp, Artificial Sequence
  Description of Artificial Sequence: Synthetic oligonucleotide
  Target: SOD1; (+) strand; PAM type: YTN; PAM sequence: CTC
acttgttaaacagaacattt

SEQ ID NO: 16876 - DNA, 20 bp, Artificial Sequence
  Description of Artificial Sequence: Synthetic oligonucleotide
  Target: SOD1; (+) strand; PAM type: YTN; PAM sequence: CTT
gttaaacagaacattttgtt

SEQ ID NO: 16877 - DNA, 20 bp, Artificial Sequence
  Description of Artificial Sequence: Synthetic oligonucleotide
  Target: SOD1; (+) strand; PAM type: YTN; PAM sequence: TTG
ttaaacagaacattttgtta

SEQ ID NO: 16878 - DNA, 20 bp, Artificial Sequence
  Description of Artificial Sequence: Synthetic oligonucleotide
  Target: SOD1; (+) strand; PAM type: YTN; PAM sequence: TTA
aacagaacattttgttaagt

SEQ ID NO: 16879 - DNA, 20 bp, Artificial Sequence
  Description of Artificial Sequence: Synthetic oligonucleotide
  Target: SOD1; (+) strand; PAM type: YTN; PAM sequence: TTT
tgttaagtttaaaacctggg

SEQ ID NO: 16880 - DNA, 20 bp, Artificial Sequence
  Description of Artificial Sequence: Synthetic oligonucleotide
  Target: SOD1; (+) strand; PAM type: YTN; PAM sequence: TTT
gttaagtttaaaacctggga

SEQ ID NO: 16881 - DNA, 20 bp, Artificial Sequence
  Description of Artificial Sequence: Synthetic oligonucleotide
  Target: SOD1; (+) strand; PAM type: YTN; PAM sequence: TTG
ttaagtttaaaacctgggat

SEQ ID NO: 16882 - DNA, 20 bp, Artificial Sequence
  Description of Artificial Sequence: Synthetic oligonucleotide
  Target: SOD1; (+) strand; PAM type: YTN; PAM sequence: TTA
agtttaaaacctgggatgga

SEQ ID NO: 16883 - DNA, 20 bp, Artificial Sequence
  Description of Artificial Sequence: Synthetic oligonucleotide
  Target: SOD1; (+) strand; PAM type: YTN; PAM sequence: TTT
aaaacctgggatggacttaa

SEQ ID NO: 16884 - DNA, 20 bp, Artificial Sequence
  Description of Artificial Sequence: Synthetic oligonucleotide
  Target: SOD1; (+) strand; PAM type: YTN; PAM sequence: TTA
aaacctgggatggacttaag

SEQ ID NO: 16885 - DNA, 20 bp, Artificial Sequence
  Description of Artificial Sequence: Synthetic oligonucleotide
  Target: SOD1; (+) strand; PAM type: YTN; PAM sequence: CTG
ggatggacttaagtattcat

SEQ ID NO: 16886 - DNA, 20 bp, Artificial Sequence
  Description of Artificial Sequence: Synthetic oligonucleotide
  Target: SOD1; (+) strand; PAM type: YTN; PAM sequence: CTT
aagtattcatgttcattcat

SEQ ID NO: 16887 - DNA, 20 bp, Artificial Sequence
  Description of Artificial Sequence: Synthetic oligonucleotide
  Target: SOD1; (+) strand; PAM type: YTN; PAM sequence: TTA
agtattcatgttcattcatg

SEQ ID NO: 16888 - DNA, 20 bp, Artificial Sequence
  Description of Artificial Sequence: Synthetic oligonucleotide
  Target: SOD1; (+) strand; PAM type: YTN; PAM sequence: TTC
atgttcattcatgttcattc

SEQ ID NO: 16889 - DNA, 20 bp, Artificial Sequence
  Description of Artificial Sequence: Synthetic oligonucleotide
  Target: SOD1; (+) strand; PAM type: YTN; PAM sequence: TTC
attcatgttcattcaggact

SEQ ID NO: 16890 - DNA, 20 bp, Artificial Sequence
  Description of Artificial Sequence: Synthetic oligonucleotide
  Target: SOD1; (+) strand; PAM type: YTN; PAM sequence: TTC
atgttcattcaggactgcag

SEQ ID NO: 16891 - DNA, 20 bp, Artificial Sequence
  Description of Artificial Sequence: Synthetic oligonucleotide
  Target: SOD1; (+) strand; PAM type: YTN; PAM sequence: TTC
attcaggactgcaggttatc

SEQ ID NO: 16892 - DNA, 20 bp, Artificial Sequence
  Description of Artificial Sequence: Synthetic oligonucleotide
  Target: SOD1; (+) strand; PAM type: YTN; PAM sequence: TTC
aggactgcaggttatcatga

SEQ ID NO: 16893 - DNA, 20 bp, Artificial Sequence
  Description of Artificial Sequence: Synthetic oligonucleotide
  Target: SOD1; (+) strand; PAM type: YTN; PAM sequence: CTG
caggttatcatgacttgttt

SEQ ID NO: 16894 - DNA, 20 bp, Artificial Sequence
  Description of Artificial Sequence: Synthetic oligonucleotide
  Target: SOD1; (+) strand; PAM type: YTN; PAM sequence: TTA
tcatgacttgtttaacttgt

SEQ ID NO: 16895 - DNA, 20 bp, Artificial Sequence
  Description of Artificial Sequence: Synthetic oligonucleotide
  Target: SOD1; (+) strand; PAM type: YTN; PAM sequence: CTT
gtttaacttgtgggaagctg

SEQ ID NO: 16896 - DNA, 20 bp, Artificial Sequence
  Description of Artificial Sequence: Synthetic oligonucleotide
  Target: SOD1; (+) strand; PAM type: YTN; PAM sequence: TTG
tttaacttgtgggaagctgt

SEQ ID NO: 16897 - DNA, 20 bp, Artificial Sequence
  Description of Artificial Sequence: Synthetic oligonucleotide
  Target: SOD1; (+) strand; PAM type: YTN; PAM sequence: TTT
aacttgtgggaagctgttgt

SEQ ID NO: 16898 - DNA, 20 bp, Artificial Sequence
  Description of Artificial Sequence: Synthetic oligonucleotide
  Target: SOD1; (+) strand; PAM type: YTN; PAM sequence: TTA
acttgtgggaagctgttgtc

SEQ ID NO: 16899 - DNA, 20 bp, Artificial Sequence
  Description of Artificial Sequence: Synthetic oligonucleotide
  Target: SOD1; (+) strand; PAM type: YTN; PAM sequence: CTT
gtgggaagctgttgtcccaa

SEQ ID NO: 16900 - DNA, 20 bp, Artificial Sequence
  Description of Artificial Sequence: Synthetic oligonucleotide
  Target: SOD1; (+) strand; PAM type: YTN; PAM sequence: TTG
tgggaagctgttgtcccaag

SEQ ID NO: 16901 - DNA, 20 bp, Artificial Sequence
  Description of Artificial Sequence: Synthetic oligonucleotide
  Target: SOD1; (+) strand; PAM type: YTN; PAM sequence: CTG
ttgtcccaagttatcctggg

SEQ ID NO: 16902 - DNA, 20 bp, Artificial Sequence
  Description of Artificial Sequence: Synthetic oligonucleotide
  Target: SOD1; (+) strand; PAM type: YTN; PAM sequence: TTG
tcccaagttatcctggggaa

SEQ ID NO: 16903 - DNA, 20 bp, Artificial Sequence
  Description of Artificial Sequence: Synthetic oligonucleotide
  Target: SOD1; (+) strand; PAM type: YTN; PAM sequence: TTA
tcctggggaactgcatctgg

SEQ ID NO: 16904 - DNA, 20 bp, Artificial Sequence
  Description of Artificial Sequence: Synthetic oligonucleotide
  Target: SOD1; (+) strand; PAM type: YTN; PAM sequence: CTG
gggaactgcatctggttctt

SEQ ID NO: 16905 - DNA, 20 bp, Artificial Sequence
  Description of Artificial Sequence: Synthetic oligonucleotide
  Target: SOD1; (+) strand; PAM type: YTN; PAM sequence: CTG
catctggttcttgcaaaaca

SEQ ID NO: 16906 - DNA, 20 bp, Artificial Sequence
  Description of Artificial Sequence: Synthetic oligonucleotide
  Target: SOD1; (+) strand; PAM type: YTN; PAM sequence: CTG
gttcttgcaaaacaccaagt

SEQ ID NO: 16907 - DNA, 20 bp, Artificial Sequence
  Description of Artificial Sequence: Synthetic oligonucleotide
  Target: SOD1; (+) strand; PAM type: YTN; PAM sequence: TTC
ttgcaaaacaccaagtagac

SEQ ID NO: 16908 - DNA, 20 bp, Artificial Sequence
  Description of Artificial Sequence: Synthetic oligonucleotide
  Target: SOD1; (+) strand; PAM type: YTN; PAM sequence: CTT
gcaaaacaccaagtagacag

SEQ ID NO: 16909 - DNA, 20 bp, Artificial Sequence
  Description of Artificial Sequence: Synthetic oligonucleotide
  Target: SOD1; (+) strand; PAM type: YTN; PAM sequence: TTG
caaaacaccaagtagacagg

SEQ ID NO: 16910 - DNA, 20 bp, Artificial Sequence
  Description of Artificial Sequence: Synthetic oligonucleotide
  Target: SOD1; (+) strand; PAM type: YTN; PAM sequence: CTC
tcttttacctccccttgagg

SEQ ID NO: 16911 - DNA, 20 bp, Artificial Sequence
  Description of Artificial Sequence: Synthetic oligonucleotide
  Target: SOD1; (+) strand; PAM type: YTN; PAM sequence: CTC
ttttacctccccttgagggc

SEQ ID NO: 16912 - DNA, 20 bp, Artificial Sequence
  Description of Artificial Sequence: Synthetic oligonucleotide
  Target: SOD1; (+) strand; PAM type: YTN; PAM sequence: CTT
ttacctccccttgagggcat

SEQ ID NO: 16913 - DNA, 20 bp, Artificial Sequence
  Description of Artificial Sequence: Synthetic oligonucleotide
  Target: SOD1; (+) strand; PAM type: YTN; PAM sequence: TTT
tacctccccttgagggcatt

SEQ ID NO: 16914 - DNA, 20 bp, Artificial Sequence
  Description of Artificial Sequence: Synthetic oligonucleotide
  Target: SOD1; (+) strand; PAM type: YTN; PAM sequence: TTT
acctccccttgagggcatta

SEQ ID NO: 16915 - DNA, 20 bp, Artificial Sequence
  Description of Artificial Sequence: Synthetic oligonucleotide
  Target: SOD1; (+) strand; PAM type: YTN; PAM sequence: TTA
cctccccttgagggcattaa

SEQ ID NO: 16916 - DNA, 20 bp, Artificial Sequence
  Description of Artificial Sequence: Synthetic oligonucleotide
  Target: SOD1; (+) strand; PAM type: YTN; PAM sequence: CTC
cccttgagggcattaacatt

SEQ ID NO: 16917 - DNA, 20 bp, Artificial Sequence
  Description of Artificial Sequence: Synthetic oligonucleotide
  Target: SOD1; (+) strand; PAM type: YTN; PAM sequence: CTT
gagggcattaacattcagta

SEQ ID NO: 16918 - DNA, 20 bp, Artificial Sequence
  Description of Artificial Sequence: Synthetic oligonucleotide
  Target: SOD1; (+) strand; PAM type: YTN; PAM sequence: TTG
agggcattaacattcagtag

SEQ ID NO: 16919 - DNA, 20 bp, Artificial Sequence
  Description of Artificial Sequence: Synthetic oligonucleotide
  Target: SOD1; (+) strand; PAM type: YTN; PAM sequence: TTA
acattcagtagtcacttcca

SEQ ID NO: 16920 - DNA, 20 bp, Artificial Sequence
  Description of Artificial Sequence: Synthetic oligonucleotide
  Target: SOD1; (+) strand; PAM type: YTN; PAM sequence: TTC
agtagtcacttccattcagt

SEQ ID NO: 16921 - DNA, 20 bp, Artificial Sequence
  Description of Artificial Sequence: Synthetic oligonucleotide
  Target: SOD1; (+) strand; PAM type: YTN; PAM sequence: CTT
ccattcagttaaccctttat

SEQ ID NO: 16922 - DNA, 20 bp, Artificial Sequence
  Description of Artificial Sequence: Synthetic oligonucleotide
  Target: SOD1; (+) strand; PAM type: YTN; PAM sequence: TTC
cattcagttaaccctttatt

SEQ ID NO: 16923 - DNA, 20 bp, Artificial Sequence
  Description of Artificial Sequence: Synthetic oligonucleotide
  Target: SOD1; (+) strand; PAM type: YTN; PAM sequence: TTC
agttaaccctttatttttat

SEQ ID NO: 16924 - DNA, 20 bp, Artificial Sequence
  Description of Artificial Sequence: Synthetic oligonucleotide
  Target: SOD1; (+) strand; PAM type: YTN; PAM sequence: TTA
accctttatttttatggttt

SEQ ID NO: 16925 - DNA, 20 bp, Artificial Sequence
  Description of Artificial Sequence: Synthetic oligonucleotide
  Target: SOD1; (+) strand; PAM type: YTN; PAM sequence: CTT
tatttttatggtttttcttg

SEQ ID NO: 16926 - DNA, 20 bp, Artificial Sequence
  Description of Artificial Sequence: Synthetic oligonucleotide
  Target: SOD1; (+) strand; PAM type: YTN; PAM sequence: TTT
atttttatggtttttcttga

SEQ ID NO: 16927 - DNA, 20 bp, Artificial Sequence
  Description of Artificial Sequence: Synthetic oligonucleotide
  Target: SOD1; (+) strand; PAM type: YTN; PAM sequence: TTA
tttttatggtttttcttgag

SEQ ID NO: 16928 - DNA, 20 bp, Artificial Sequence
  Description of Artificial Sequence: Synthetic oligonucleotide
  Target: SOD1; (+) strand; PAM type: YTN; PAM sequence: TTT
ttatggtttttcttgagcca

SEQ ID NO: 16929 - DNA, 20 bp, Artificial Sequence
  Description of Artificial Sequence: Synthetic oligonucleotide
  Target: SOD1; (+) strand; PAM type: YTN; PAM sequence: TTT
tatggtttttcttgagccat

SEQ ID NO: 16930 - DNA, 20 bp, Artificial Sequence
  Description of Artificial Sequence: Synthetic oligonucleotide
  Target: SOD1; (+) strand; PAM type: YTN; PAM sequence: TTT
atggtttttcttgagccata

SEQ ID NO: 16931 - DNA, 20 bp, Artificial Sequence
  Description of Artificial Sequence: Synthetic oligonucleotide
  Target: SOD1; (+) strand; PAM type: YTN; PAM sequence: TTA
tggtttttcttgagccatag

SEQ ID NO: 16932 - DNA, 20 bp, Artificial Sequence
  Description of Artificial Sequence: Synthetic oligonucleotide
  Target: SOD1; (+) strand; PAM type: YTN; PAM sequence: TTT
ttcttgagccatagttgtaa

SEQ ID NO: 16933 - DNA, 20 bp, Artificial Sequence
  Description of Artificial Sequence: Synthetic oligonucleotide
  Target: SOD1; (+) strand; PAM type: YTN; PAM sequence: TTT
tcttgagccatagttgtaaa

SEQ ID NO: 16934 - DNA, 20 bp, Artificial Sequence
  Description of Artificial Sequence: Synthetic oligonucleotide
  Target: SOD1; (+) strand; PAM type: YTN; PAM sequence: TTT
cttgagccatagttgtaaag

SEQ ID NO: 16935 - DNA, 20 bp, Artificial Sequence
  Description of Artificial Sequence: Synthetic oligonucleotide
  Target: SOD1; (+) strand; PAM type: YTN; PAM sequence: TTC
ttgagccatagttgtaaagc

SEQ ID NO: 16936 - DNA, 20 bp, Artificial Sequence
  Description of Artificial Sequence: Synthetic oligonucleotide
  Target: SOD1; (+) strand; PAM type: YTN; PAM sequence: CTT
gagccatagttgtaaagcag

SEQ ID NO: 16937 - DNA, 20 bp, Artificial Sequence
  Description of Artificial Sequence: Synthetic oligonucleotide
  Target: SOD1; (+) strand; PAM type: YTN; PAM sequence: TTG
agccatagttgtaaagcaga

SEQ ID NO: 16938 - DNA, 20 bp, Artificial Sequence
  Description of Artificial Sequence: Synthetic oligonucleotide
  Target: SOD1; (+) strand; PAM type: YTN; PAM sequence: TTG
taaagcagaaaaatcattta

SEQ ID NO: 16939 - DNA, 20 bp, Artificial Sequence
  Description of Artificial Sequence: Synthetic oligonucleotide
  Target: SOD1; (+) strand; PAM type: YTN; PAM sequence: TTT
ataaaggtttgttgaacaaa

SEQ ID NO: 16940 - DNA, 20 bp, Artificial Sequence
  Description of Artificial Sequence: Synthetic oligonucleotide
  Target: SOD1; (+) strand; PAM type: YTN; PAM sequence: TTA
taaaggtttgttgaacaaaa

SEQ ID NO: 16941 - DNA, 20 bp, Artificial Sequence
  Description of Artificial Sequence: Synthetic oligonucleotide
  Target: SOD1; (+) strand; PAM type: YTN; PAM sequence: TTT
gttgaacaaaattcaaaata

SEQ ID NO: 16942 - DNA, 20 bp, Artificial Sequence
  Description of Artificial Sequence: Synthetic oligonucleotide
  Target: SOD1; (+) strand; PAM type: YTN; PAM sequence: TTG
ttgaacaaaattcaaaatac

SEQ ID NO: 16943 - DNA, 20 bp, Artificial Sequence
  Description of Artificial Sequence: Synthetic oligonucleotide
  Target: SOD1; (+) strand; PAM type: YTN; PAM sequence: TTG
aacaaaattcaaaatactgt

SEQ ID NO: 16944 - DNA, 20 bp, Artificial Sequence
  Description of Artificial Sequence: Synthetic oligonucleotide
  Target: SOD1; (+) strand; PAM type: YTN; PAM sequence: TTC
aaaatactgttgcttaaagt

SEQ ID NO: 16945 - DNA, 20 bp, Artificial Sequence
  Description of Artificial Sequence: Synthetic oligonucleotide
  Target: SOD1; (+) strand; PAM type: YTN; PAM sequence: CTG
ttgcttaaagtattaagatt

SEQ ID NO: 16946 - DNA, 20 bp, Artificial Sequence
  Description of Artificial Sequence: Synthetic oligonucleotide
  Target: SOD1; (+) strand; PAM type: YTN; PAM sequence: TTG
cttaaagtattaagattttt

SEQ ID NO: 16947 - DNA, 20 bp, Artificial Sequence
  Description of Artificial Sequence: Synthetic oligonucleotide
  Target: SOD1; (+) strand; PAM type: YTN; PAM sequence: CTT
aaagtattaagattttttag

SEQ ID NO: 16948 - DNA, 20 bp, Artificial Sequence
  Description of Artificial Sequence: Synthetic oligonucleotide
  Target: SOD1; (+) strand; PAM type: YTN; PAM sequence: TTA
aagtattaagattttttagg

SEQ ID NO: 16949 - DNA, 20 bp, Artificial Sequence
  Description of Artificial Sequence: Synthetic oligonucleotide
  Target: SOD1; (+) strand; PAM type: YTN; PAM sequence: TTA
agattttttaggattatacc

SEQ ID NO: 16950 - DNA, 20 bp, Artificial Sequence
  Description of Artificial Sequence: Synthetic oligonucleotide
  Target: SOD1; (+) strand; PAM type: YTN; PAM sequence: TTT
tttaggattataccttactt

SEQ ID NO: 16951 - DNA, 20 bp, Artificial Sequence
  Description of Artificial Sequence: Synthetic oligonucleotide
  Target: SOD1; (+) strand; PAM type: YTN; PAM sequence: TTT
ttaggattataccttactta

SEQ ID NO: 16952 - DNA, 20 bp, Artificial Sequence
  Description of Artificial Sequence: Synthetic oligonucleotide
  Target: SOD1; (+) strand; PAM type: YTN; PAM sequence: TTT
taggattataccttacttat

SEQ ID NO: 16953 - DNA, 20 bp, Artificial Sequence
  Description of Artificial Sequence: Synthetic oligonucleotide
  Target: SOD1; (+) strand; PAM type: YTN; PAM sequence: TTT
aggattataccttacttata

SEQ ID NO: 16954 - DNA, 20 bp, Artificial Sequence
  Description of Artificial Sequence: Synthetic oligonucleotide
  Target: SOD1; (+) strand; PAM type: YTN; PAM sequence: TTA
ggattataccttacttatag

SEQ ID NO: 16955 - DNA, 20 bp, Artificial Sequence
  Description of Artificial Sequence: Synthetic oligonucleotide
  Target: SOD1; (+) strand; PAM type: YTN; PAM sequence: TTA
taccttacttataggcccgt

SEQ ID NO: 16956 - DNA, 20 bp, Artificial Sequence
  Description of Artificial Sequence: Synthetic oligonucleotide
  Target: SOD1; (+) strand; PAM type: YTN; PAM sequence: CTT
acttataggcccgtcattca

SEQ ID NO: 16957 - DNA, 20 bp, Artificial Sequence
  Description of Artificial Sequence: Synthetic oligonucleotide
  Target: SOD1; (+) strand; PAM type: YTN; PAM sequence: TTA
cttataggcccgtcattcat

SEQ ID NO: 16958 - DNA, 20 bp, Artificial Sequence
  Description of Artificial Sequence: Synthetic oligonucleotide
  Target: SOD1; (+) strand; PAM type: YTN; PAM sequence: CTT
ataggcccgtcattcatttg

SEQ ID NO: 16959 - DNA, 20 bp, Artificial Sequence
  Description of Artificial Sequence: Synthetic oligonucleotide
  Target: SOD1; (+) strand; PAM type: YTN; PAM sequence: TTA
taggcccgtcattcatttgg

SEQ ID NO: 16960 - DNA, 20 bp, Artificial Sequence
  Description of Artificial Sequence: Synthetic oligonucleotide
  Target: SOD1; (+) strand; PAM type: YTN; PAM sequence: TTC
atttggcatgaaattttgag

SEQ ID NO: 16961 - DNA, 20 bp, Artificial Sequence
  Description of Artificial Sequence: Synthetic oligonucleotide
  Target: SOD1; (+) strand; PAM type: YTN; PAM sequence: TTT
ggcatgaaattttgagtttt

SEQ ID NO: 16962 - DNA, 20 bp, Artificial Sequence
  Description of Artificial Sequence: Synthetic oligonucleotide
  Target: SOD1; (+) strand; PAM type: YTN; PAM sequence: TTG
gcatgaaattttgagtttta

SEQ ID NO: 16963 - DNA, 20 bp, Artificial Sequence
  Description of Artificial Sequence: Synthetic oligonucleotide
  Target: SOD1; (+) strand; PAM type: YTN; PAM sequence: TTT
tgagttttattcactttcac

SEQ ID NO: 16964 - DNA, 20 bp, Artificial Sequence
  Description of Artificial Sequence: Synthetic oligonucleotide
  Target: SOD1; (+) strand; PAM type: YTN; PAM sequence: TTT
gagttttattcactttcact

SEQ ID NO: 16965 - DNA, 20 bp, Artificial Sequence
  Description of Artificial Sequence: Synthetic oligonucleotide
  Target: SOD1; (+) strand; PAM type: YTN; PAM sequence: TTG
agttttattcactttcactt

SEQ ID NO: 16966 - DNA, 20 bp, Artificial Sequence
  Description of Artificial Sequence: Synthetic oligonucleotide
  Target: SOD1; (+) strand; PAM type: YTN; PAM sequence: TTT
tattcactttcactttcctt

SEQ ID NO: 16967 - DNA, 20 bp, Artificial Sequence
  Description of Artificial Sequence: Synthetic oligonucleotide
  Target: SOD1; (+) strand; PAM type: YTN; PAM sequence: TTT
attcactttcactttccttt

SEQ ID NO: 16968 - DNA, 20 bp, Artificial Sequence
  Description of Artificial Sequence: Synthetic oligonucleotide
  Target: SOD1; (+) strand; PAM type: YTN; PAM sequence: TTA
ttcactttcactttcctttt

SEQ ID NO: 16969 - DNA, 20 bp, Artificial Sequence
  Description of Artificial Sequence: Synthetic oligonucleotide
  Target: SOD1; (+) strand; PAM type: YTN; PAM sequence: TTC
actttcactttccttttttt

SEQ ID NO: 16970 - DNA, 20 bp, Artificial Sequence
  Description of Artificial Sequence: Synthetic oligonucleotide
  Target: SOD1; (+) strand; PAM type: YTN; PAM sequence: CTT
tcactttcctttttttccaa

SEQ ID NO: 16971 - DNA, 20 bp, Artificial Sequence
  Description of Artificial Sequence: Synthetic oligonucleotide
  Target: SOD1; (+) strand; PAM type: YTN; PAM sequence: TTT
cactttcctttttttccaaa

SEQ ID NO: 16972 - DNA, 20 bp, Artificial Sequence
  Description of Artificial Sequence: Synthetic oligonucleotide
  Target: SOD1; (+) strand; PAM type: YTN; PAM sequence: TTC
actttcctttttttccaaag

SEQ ID NO: 16973 - DNA, 20 bp, Artificial Sequence
  Description of Artificial Sequence: Synthetic oligonucleotide
  Target: SOD1; (+) strand; PAM type: YTN; PAM sequence: CTT
tcctttttttccaaagcaat

SEQ ID NO: 16974 - DNA, 20 bp, Artificial Sequence
  Description of Artificial Sequence: Synthetic oligonucleotide
  Target: SOD1; (+) strand; PAM type: YTN; PAM sequence: TTT
cctttttttccaaagcaatt

SEQ ID NO: 16975 - DNA, 20 bp, Artificial Sequence
  Description of Artificial Sequence: Synthetic oligonucleotide
  Target: SOD1; (+) strand; PAM type: YTN; PAM sequence: TTC
ctttttttccaaagcaatta

SEQ ID NO: 16976 - DNA, 20 bp, Artificial Sequence
  Description of Artificial Sequence: Synthetic oligonucleotide
  Target: SOD1; (+) strand; PAM type: YTN; PAM sequence: CTT
tttttccaaagcaattaaaa

SEQ ID NO: 16977 - DNA, 20 bp, Artificial Sequence
  Description of Artificial Sequence: Synthetic oligonucleotide
  Target: SOD1; (+) strand; PAM type: YTN; PAM sequence: TTT
ttttccaaagcaattaaaaa

SEQ ID NO: 16978 - DNA, 20 bp, Artificial Sequence
  Description of Artificial Sequence: Synthetic oligonucleotide
  Target: SOD1; (+) strand; PAM type: YTN; PAM sequence: TTT
tttccaaagcaattaaaaaa

SEQ ID NO: 16979 - DNA, 20 bp, Artificial Sequence
  Description of Artificial Sequence: Synthetic oligonucleotide
  Target: SOD1; (+) strand; PAM type: YTN; PAM sequence: TTT
ttccaaagcaattaaaaaaa

SEQ ID NO: 16980 - DNA, 20 bp, Artificial Sequence
  Description of Artificial Sequence: Synthetic oligonucleotide
  Target: SOD1; (+) strand; PAM type: YTN; PAM sequence: TTT
tccaaagcaattaaaaaaac

SEQ ID NO: 16981 - DNA, 20 bp, Artificial Sequence
  Description of Artificial Sequence: Synthetic oligonucleotide
  Target: SOD1; (+) strand; PAM type: YTN; PAM sequence: TTT
ccaaagcaattaaaaaaact

SEQ ID NO: 16982 - DNA, 20 bp, Artificial Sequence
  Description of Artificial Sequence: Synthetic oligonucleotide
  Target: SOD1; (+) strand; PAM type: YTN; PAM sequence: TTC
caaagcaattaaaaaaactg

SEQ ID NO: 16983 - DNA, 20 bp, Artificial Sequence
  Description of Artificial Sequence: Synthetic oligonucleotide
  Target: SOD1; (+) strand; PAM type: YTN; PAM sequence: TTA
aaaaaactgccaaagtaaga

SEQ ID NO: 16984 - DNA, 20 bp, Artificial Sequence
  Description of Artificial Sequence: Synthetic oligonucleotide
  Target: SOD1; (+) strand; PAM type: YTN; PAM sequence: CTG
ccaaagtaagagtgactgcg

SEQ ID NO: 16985 - DNA, 20 bp, Artificial Sequence
  Description of Artificial Sequence: Synthetic oligonucleotide
  Target: SOD1; (+) strand; PAM type: YTN; PAM sequence: CTG
cggaactaaggttactgtaa

SEQ ID NO: 16986 - DNA, 20 bp, Artificial Sequence
  Description of Artificial Sequence: Synthetic oligonucleotide
  Target: SOD1; (+) strand; PAM type: YTN; PAM sequence: CTA
aggttactgtaacttaccat

SEQ ID NO: 16987 - DNA, 20 bp, Artificial Sequence
  Description of Artificial Sequence: Synthetic oligonucleotide
  Target: SOD1; (+) strand; PAM type: YTN; PAM sequence: TTA
ctgtaacttaccatggagga

SEQ ID NO: 16988 - DNA, 20 bp, Artificial Sequence
  Description of Artificial Sequence: Synthetic oligonucleotide
  Target: SOD1; (+) strand; PAM type: YTN; PAM sequence: CTG
taacttaccatggaggatta

SEQ ID NO: 16989 - DNA, 20 bp, Artificial Sequence
  Description of Artificial Sequence: Synthetic oligonucleotide
  Target: SOD1; (+) strand; PAM type: YTN; PAM sequence: CTT
accatggaggattaagggta

SEQ ID NO: 16990 - DNA, 20 bp, Artificial Sequence
  Description of Artificial Sequence: Synthetic oligonucleotide
  Target: SOD1; (+) strand; PAM type: YTN; PAM sequence: TTA
ccatggaggattaagggtag

SEQ ID NO: 16991 - DNA, 20 bp, Artificial Sequence
  Description of Artificial Sequence: Synthetic oligonucleotide
  Target: SOD1; (+) strand; PAM type: YTN; PAM sequence: TTA
agggtagcgtgtggtggtct

SEQ ID NO: 16992 - DNA, 20 bp, Artificial Sequence
  Description of Artificial Sequence: Synthetic oligonucleotide
  Target: SOD1; (+) strand; PAM type: YTN; PAM sequence: CTA
caacatagttatttgggttt

SEQ ID NO: 16993 - DNA, 20 bp, Artificial Sequence
  Description of Artificial Sequence: Synthetic oligonucleotide
  Target: SOD1; (+) strand; PAM type: YTN; PAM sequence: TTA
tttgggttttagtatttcat

SEQ ID NO: 16994 - DNA, 20 bp, Artificial Sequence
  Description of Artificial Sequence: Synthetic oligonucleotide
  Target: SOD1; (+) strand; PAM type: YTN; PAM sequence: TTT
gggttttagtatttcattta

SEQ ID NO: 16995 - DNA, 20 bp, Artificial Sequence
  Description of Artificial Sequence: Synthetic oligonucleotide
  Target: SOD1; (+) strand; PAM type: YTN; PAM sequence: TTG
ggttttagtatttcatttag

SEQ ID NO: 16996 - DNA, 20 bp, Artificial Sequence
  Description of Artificial Sequence: Synthetic oligonucleotide
  Target: SOD1; (+) strand; PAM type: YTN; PAM sequence: TTT
tagtatttcatttagacagc

SEQ ID NO: 16997 - DNA, 20 bp, Artificial Sequence
  Description of Artificial Sequence: Synthetic oligonucleotide
  Target: SOD1; (+) strand; PAM type: YTN; PAM sequence: TTT
agtatttcatttagacagca

SEQ ID NO: 16998 - DNA, 20 bp, Artificial Sequence
  Description of Artificial Sequence: Synthetic oligonucleotide
  Target: SOD1; (+) strand; PAM type: YTN; PAM sequence: TTA
gtatttcatttagacagcaa

SEQ ID NO: 16999 - DNA, 20 bp, Artificial Sequence
  Description of Artificial Sequence: Synthetic oligonucleotide
  Target: SOD1; (+) strand; PAM type: YTN; PAM sequence: TTT
catttagacagcaacactta

SEQ ID NO: 17000 - DNA, 20 bp, Artificial Sequence
  Description of Artificial Sequence: Synthetic oligonucleotide
  Target: SOD1; (+) strand; PAM type: YTN; PAM sequence: TTC
atttagacagcaacacttac

SEQ ID NO: 17001 - DNA, 20 bp, Artificial Sequence
  Description of Artificial Sequence: Synthetic oligonucleotide
  Target: SOD1; (+) strand; PAM type: YTN; PAM sequence: TTT
agacagcaacacttacctaa

SEQ ID NO: 17002 - DNA, 20 bp, Artificial Sequence
  Description of Artificial Sequence: Synthetic oligonucleotide
  Target: SOD1; (+) strand; PAM type: YTN; PAM sequence: TTA
gacagcaacacttacctaat

SEQ ID NO: 17003 - DNA, 20 bp, Artificial Sequence
  Description of Artificial Sequence: Synthetic oligonucleotide
  Target: SOD1; (+) strand; PAM type: YTN; PAM sequence: CTT
acctaatgtttaaaggtaat

SEQ ID NO: 17004 - DNA, 20 bp, Artificial Sequence
  Description of Artificial Sequence: Synthetic oligonucleotide
  Target: SOD1; (+) strand; PAM type: YTN; PAM sequence: TTA
cctaatgtttaaaggtaatg

SEQ ID NO: 17005 - DNA, 20 bp, Artificial Sequence
  Description of Artificial Sequence: Synthetic oligonucleotide
  Target: SOD1; (+) strand; PAM type: YTN; PAM sequence: CTA
atgtttaaaggtaatgtctt

SEQ ID NO: 17006 - DNA, 20 bp, Artificial Sequence
  Description of Artificial Sequence: Synthetic oligonucleotide
  Target: SOD1; (+) strand; PAM type: YTN; PAM sequence: TTT
aaaggtaatgtctttgcaac

SEQ ID NO: 17007 - DNA, 20 bp, Artificial Sequence
  Description of Artificial Sequence: Synthetic oligonucleotide
  Target: SOD1; (+) strand; PAM type: YTN; PAM sequence: TTA
aaggtaatgtctttgcaaca

SEQ ID NO: 17008 - DNA, 20 bp, Artificial Sequence
  Description of Artificial Sequence: Synthetic oligonucleotide
  Target: SOD1; (+) strand; PAM type: YTN; PAM sequence: CTT
tgcaacaccaagaaaaagct

SEQ ID NO: 17009 - DNA, 20 bp, Artificial Sequence
  Description of Artificial Sequence: Synthetic oligonucleotide
  Target: SOD1; (+) strand; PAM type: YTN; PAM sequence: TTT
gcaacaccaagaaaaagctt

SEQ ID NO: 17010 - DNA, 20 bp, Artificial Sequence
  Description of Artificial Sequence: Synthetic oligonucleotide
  Target: SOD1; (+) strand; PAM type: YTN; PAM sequence: TTG
caacaccaagaaaaagcttt

SEQ ID NO: 17011 - DNA, 20 bp, Artificial Sequence
  Description of Artificial Sequence: Synthetic oligonucleotide
  Target: SOD1; (+) strand; PAM type: YTN; PAM sequence: CTT
tgagtagtagtttctacttt

SEQ ID NO: 17012 - DNA, 20 bp, Artificial Sequence
  Description of Artificial Sequence: Synthetic oligonucleotide
  Target: SOD1; (+) strand; PAM type: YTN; PAM sequence: TTT
gagtagtagtttctactttt

SEQ ID NO: 17013 - DNA, 20 bp, Artificial Sequence
  Description of Artificial Sequence: Synthetic oligonucleotide
  Target: SOD1; (+) strand; PAM type: YTN; PAM sequence: TTG
agtagtagtttctactttta

SEQ ID NO: 17014 - DNA, 20 bp, Artificial Sequence
  Description of Artificial Sequence: Synthetic oligonucleotide
  Target: SOD1; (+) strand; PAM type: YTN; PAM sequence: TTT
ctacttttaaactactaaat

SEQ ID NO: 17015 - DNA, 20 bp, Artificial Sequence
  Description of Artificial Sequence: Synthetic oligonucleotide
  Target: SOD1; (+) strand; PAM type: YTN; PAM sequence: TTC
tacttttaaactactaaata

SEQ ID NO: 17016 - DNA, 20 bp, Artificial Sequence
  Description of Artificial Sequence: Synthetic oligonucleotide
  Target: SOD1; (+) strand; PAM type: YTN; PAM sequence: CTA
cttttaaactactaaatatt

SEQ ID NO: 17017 - DNA, 20 bp, Artificial Sequence
  Description of Artificial Sequence: Synthetic oligonucleotide
  Target: SOD1; (+) strand; PAM type: YTN; PAM sequence: CTT
ttaaactactaaatattagt

SEQ ID NO: 17018 - DNA, 20 bp, Artificial Sequence
  Description of Artificial Sequence: Synthetic oligonucleotide
  Target: SOD1; (+) strand; PAM type: YTN; PAM sequence: TTT
taaactactaaatattagta

SEQ ID NO: 17019 - DNA, 20 bp, Artificial Sequence
  Description of Artificial Sequence: Synthetic oligonucleotide
  Target: SOD1; (+) strand; PAM type: YTN; PAM sequence: TTT
aaactactaaatattagtat

SEQ ID NO: 17020 - DNA, 20 bp, Artificial Sequence
  Description of Artificial Sequence: Synthetic oligonucleotide
  Target: SOD1; (+) strand; PAM type: YTN; PAM sequence: TTA
aactactaaatattagtata

SEQ ID NO: 17021 - DNA, 20 bp, Artificial Sequence
  Description of Artificial Sequence: Synthetic oligonucleotide
  Target: SOD1; (+) strand; PAM type: YTN; PAM sequence: CTA
ctaaatattagtatatctct

SEQ ID NO: 17022 - DNA, 20 bp, Artificial Sequence
  Description of Artificial Sequence: Synthetic oligonucleotide
  Target: SOD1; (+) strand; PAM type: YTN; PAM sequence: CTA
aatattagtatatctctcta

SEQ ID NO: 17023 - DNA, 20 bp, Artificial Sequence
  Description of Artificial Sequence: Synthetic oligonucleotide
  Target: SOD1; (+) strand; PAM type: YTN; PAM sequence: TTA
gtatatctctctactaggat

SEQ ID NO: 17024 - DNA, 20 bp, Artificial Sequence
  Description of Artificial Sequence: Synthetic oligonucleotide
  Target: SOD1; (+) strand; PAM type: YTN; PAM sequence: CTC
tctactaggattaatgttat

SEQ ID NO: 17025 - DNA, 20 bp, Artificial Sequence
  Description of Artificial Sequence: Synthetic oligonucleotide
  Target: SOD1; (+) strand; PAM type: YTN; PAM sequence: CTC
tactaggattaatgttattt

SEQ ID NO: 17026 - DNA, 20 bp, Artificial Sequence
  Description of Artificial Sequence: Synthetic oligonucleotide
  Target: SOD1; (+) strand; PAM type: YTN; PAM sequence: CTA
ctaggattaatgttattttt

SEQ ID NO: 17027 - DNA, 20 bp, Artificial Sequence
  Description of Artificial Sequence: Synthetic oligonucleotide
  Target: SOD1; (+) strand; PAM type: YTN; PAM sequence: CTA
ggattaatgttatttttcta

SEQ ID NO: 17028 - DNA, 20 bp, Artificial Sequence
  Description of Artificial Sequence: Synthetic oligonucleotide
  Target: SOD1; (+) strand; PAM type: YTN; PAM sequence: TTA
atgttatttttctaatatta

SEQ ID NO: 17029 - DNA, 20 bp, Artificial Sequence
  Description of Artificial Sequence: Synthetic oligonucleotide
  Target: SOD1; (+) strand; PAM type: YTN; PAM sequence: TTA
tttttctaatattatgaggt

SEQ ID NO: 17030 - DNA, 20 bp, Artificial Sequence
  Description of Artificial Sequence: Synthetic oligonucleotide
  Target: SOD1; (+) strand; PAM type: YTN; PAM sequence: TTT
ttctaatattatgaggttct

SEQ ID NO: 17031 - DNA, 20 bp, Artificial Sequence
  Description of Artificial Sequence: Synthetic oligonucleotide
  Target: SOD1; (+) strand; PAM type: YTN; PAM sequence: TTT
tctaatattatgaggttctt

SEQ ID NO: 17032 - DNA, 20 bp, Artificial Sequence
  Description of Artificial Sequence: Synthetic oligonucleotide
  Target: SOD1; (+) strand; PAM type: YTN; PAM sequence: TTT
ctaatattatgaggttctta

SEQ ID NO: 17033 - DNA, 20 bp, Artificial Sequence
  Description of Artificial Sequence: Synthetic oligonucleotide
  Target: SOD1; (+) strand; PAM type: YTN; PAM sequence: TTC
taatattatgaggttcttaa

SEQ ID NO: 17034 - DNA, 20 bp, Artificial Sequence
  Description of Artificial Sequence: Synthetic oligonucleotide
  Target: SOD1; (+) strand; PAM type: YTN; PAM sequence: CTA
atattatgaggttcttaaac

SEQ ID NO: 17035 - DNA, 20 bp, Artificial Sequence
  Description of Artificial Sequence: Synthetic oligonucleotide
  Target: SOD1; (+) strand; PAM type: YTN; PAM sequence: TTA
tgaggttcttaaacatcttt

SEQ ID NO: 17036 - DNA, 20 bp, Artificial Sequence
  Description of Artificial Sequence: Synthetic oligonucleotide
  Target: SOD1; (+) strand; PAM type: YTN; PAM sequence: TTC
ttaaacatcttttgggtatt

SEQ ID NO: 17037 - DNA, 20 bp, Artificial Sequence
  Description of Artificial Sequence: Synthetic oligonucleotide
  Target: SOD1; (+) strand; PAM type: YTN; PAM sequence: CTT
aaacatcttttgggtattgt

SEQ ID NO: 17038 - DNA, 20 bp, Artificial Sequence
  Description of Artificial Sequence: Synthetic oligonucleotide
  Target: SOD1; (+) strand; PAM type: YTN; PAM sequence: TTA
aacatcttttgggtattgtt

SEQ ID NO: 17039 - DNA, 20 bp, Artificial Sequence
  Description of Artificial Sequence: Synthetic oligonucleotide
  Target: SOD1; (+) strand; PAM type: YTN; PAM sequence: CTT
ttgggtattgttgggaggag

SEQ ID NO: 17040 - DNA, 20 bp, Artificial Sequence
  Description of Artificial Sequence: Synthetic oligonucleotide
  Target: SOD1; (+) strand; PAM type: YTN; PAM sequence: TTT
tgggtattgttgggaggagg

SEQ ID NO: 17041 - DNA, 20 bp, Artificial Sequence
  Description of Artificial Sequence: Synthetic oligonucleotide
  Target: SOD1; (+) strand; PAM type: YTN; PAM sequence: TTT
gggtattgttgggaggaggt

SEQ ID NO: 17042 - DNA, 20 bp, Artificial Sequence
  Description of Artificial Sequence: Synthetic oligonucleotide
  Target: SOD1; (+) strand; PAM type: YTN; PAM sequence: TTG
ggtattgttgggaggaggta

SEQ ID NO: 17043 - DNA, 20 bp, Artificial Sequence
  Description of Artificial Sequence: Synthetic oligonucleotide
  Target: SOD1; (+) strand; PAM type: YTN; PAM sequence: TTG
ttgggaggaggtagtgatta

SEQ ID NO: 17044 - DNA, 20 bp, Artificial Sequence
  Description of Artificial Sequence: Synthetic oligonucleotide
  Target: SOD1; (+) strand; PAM type: YTN; PAM sequence: TTG
ggaggaggtagtgattactt

SEQ ID NO: 17045 - DNA, 20 bp, Artificial Sequence
  Description of Artificial Sequence: Synthetic oligonucleotide
  Target: SOD1; (+) strand; PAM type: YTN; PAM sequence: TTA
cttgacagcccaaagttatc

SEQ ID NO: 17046 - DNA, 20 bp, Artificial Sequence
  Description of Artificial Sequence: Synthetic oligonucleotide
  Target: SOD1; (+) strand; PAM type: YTN; PAM sequence: CTT
gacagcccaaagttatcttc

SEQ ID NO: 17047 - DNA, 20 bp, Artificial Sequence
  Description of Artificial Sequence: Synthetic oligonucleotide
  Target: SOD1; (+) strand; PAM type: YTN; PAM sequence: TTG
acagcccaaagttatcttct

SEQ ID NO: 17048 - DNA, 20 bp, Artificial Sequence
  Description of Artificial Sequence: Synthetic oligonucleotide
  Target: SOD1; (+) strand; PAM type: YTN; PAM sequence: TTA
tcttcttaaaattttttaca

SEQ ID NO: 17049 - DNA, 20 bp, Artificial Sequence
  Description of Artificial Sequence: Synthetic oligonucleotide
  Target: SOD1; (+) strand; PAM type: YTN; PAM sequence: CTT
cttaaaattttttacaggtc

SEQ ID NO: 17050 - DNA, 20 bp, Artificial Sequence
  Description of Artificial Sequence: Synthetic oligonucleotide
  Target: SOD1; (+) strand; PAM type: YTN; PAM sequence: TTC
ttaaaattttttacaggtcc

SEQ ID NO: 17051 - DNA, 20 bp, Artificial Sequence
  Description of Artificial Sequence: Synthetic oligonucleotide
  Target: SOD1; (+) strand; PAM type: YTN; PAM sequence: CTT
aaaattttttacaggtccat

SEQ ID NO: 17052 - DNA, 20 bp, Artificial Sequence
  Description of Artificial Sequence: Synthetic oligonucleotide
  Target: SOD1; (+) strand; PAM type: YTN; PAM sequence: TTA
aaattttttacaggtccatg

SEQ ID NO: 17053 - DNA, 20 bp, Artificial Sequence
  Description of Artificial Sequence: Synthetic oligonucleotide
  Target: SOD1; (+) strand; PAM type: YTN; PAM sequence: TTT
tttacaggtccatgaaaaag

SEQ ID NO: 17054 - DNA, 20 bp, Artificial Sequence
  Description of Artificial Sequence: Synthetic oligonucleotide
  Target: SOD1; (+) strand; PAM type: YTN; PAM sequence: TTT
ttacaggtccatgaaaaagc

SEQ ID NO: 17055 - DNA, 20 bp, Artificial Sequence
  Description of Artificial Sequence: Synthetic oligonucleotide
  Target: SOD1; (+) strand; PAM type: YTN; PAM sequence: TTT
tacaggtccatgaaaaagca

SEQ ID NO: 17056 - DNA, 20 bp, Artificial Sequence
  Description of Artificial Sequence: Synthetic oligonucleotide
  Target: SOD1; (+) strand; PAM type: YTN; PAM sequence: TTT
acaggtccatgaaaaagcag

SEQ ID NO: 17057 - DNA, 20 bp, Artificial Sequence
  Description of Artificial Sequence: Synthetic oligonucleotide
  Target: SOD1; (+) strand; PAM type: YTN; PAM sequence: TTA
caggtccatgaaaaagcaga

SEQ ID NO: 17058 - DNA, 20 bp, Artificial Sequence
  Description of Artificial Sequence: Synthetic oligonucleotide
  Target: SOD1; (+) strand; PAM type: YTN; PAM sequence: CTT
gggcaaaggtggaaatgaag

SEQ ID NO: 17059 - DNA, 20 bp, Artificial Sequence
  Description of Artificial Sequence: Synthetic oligonucleotide
  Target: SOD1; (+) strand; PAM type: YTN; PAM sequence: TTG
ggcaaaggtggaaatgaaga

SEQ ID NO: 17060 - DNA, 20 bp, Artificial Sequence
  Description of Artificial Sequence: Synthetic oligonucleotide
  Target: SOD1; (+) strand; PAM type: YTN; PAM sequence: CTG
gaagtcgtttggcttgtggt

SEQ ID NO: 17061 - DNA, 20 bp, Artificial Sequence
  Description of Artificial Sequence: Synthetic oligonucleotide
  Target: SOD1; (+) strand; PAM type: YTN; PAM sequence: TTT
ggcttgtggtgtaattggga

SEQ ID NO: 17062 - DNA, 20 bp, Artificial Sequence
  Description of Artificial Sequence: Synthetic oligonucleotide
  Target: SOD1; (+) strand; PAM type: YTN; PAM sequence: TTG
gcttgtggtgtaattgggat

SEQ ID NO: 17063 - DNA, 20 bp, Artificial Sequence
  Description of Artificial Sequence: Synthetic oligonucleotide
  Target: SOD1; (+) strand; PAM type: YTN; PAM sequence: CTT
gtggtgtaattgggatcgcc

SEQ ID NO: 17064 - DNA, 20 bp, Artificial Sequence
  Description of Artificial Sequence: Synthetic oligonucleotide
  Target: SOD1; (+) strand; PAM type: YTN; PAM sequence: TTG
tggtgtaattgggatcgccc

SEQ ID NO: 17065 - DNA, 20 bp, Artificial Sequence
  Description of Artificial Sequence: Synthetic oligonucleotide
  Target: SOD1; (+) strand; PAM type: YTN; PAM sequence: TTG
ggatcgcccaataaacattc

SEQ ID NO: 17066 - DNA, 20 bp, Artificial Sequence
  Description of Artificial Sequence: Synthetic oligonucleotide
  Target: SOD1; (+) strand; PAM type: YTN; PAM sequence: TTC
ccttggatgtagtctgaggc

SEQ ID NO: 17067 - DNA, 20 bp, Artificial Sequence
  Description of Artificial Sequence: Synthetic oligonucleotide
  Target: SOD1; (+) strand; PAM type: YTN; PAM sequence: CTT
ggatgtagtctgaggcccct

SEQ ID NO: 17068 - DNA, 20 bp, Artificial Sequence
  Description of Artificial Sequence: Synthetic oligonucleotide
  Target: SOD1; (+) strand; PAM type: YTN; PAM sequence: TTG
gatgtagtctgaggcccctt

SEQ ID NO: 17069 - DNA, 20 bp, Artificial Sequence
  Description of Artificial Sequence: Synthetic oligonucleotide
  Target: SOD1; (+) strand; PAM type: YTN; PAM sequence: CTG
aggccccttaactcatctgt

SEQ ID NO: 17070 - DNA, 20 bp, Artificial Sequence
  Description of Artificial Sequence: Synthetic oligonucleotide
  Target: SOD1; (+) strand; PAM type: YTN; PAM sequence: CTT
aactcatctgttatcctgct

SEQ ID NO: 17071 - DNA, 20 bp, Artificial Sequence
  Description of Artificial Sequence: Synthetic oligonucleotide
  Target: SOD1; (+) strand; PAM type: YTN; PAM sequence: TTA
actcatctgttatcctgcta

SEQ ID NO: 17072 - DNA, 20 bp, Artificial Sequence
  Description of Artificial Sequence: Synthetic oligonucleotide
  Target: SOD1; (+) strand; PAM type: YTN; PAM sequence: CTC
atctgttatcctgctagctg

SEQ ID NO: 17073 - DNA, 20 bp, Artificial Sequence
  Description of Artificial Sequence: Synthetic oligonucleotide
  Target: SOD1; (+) strand; PAM type: YTN; PAM sequence: CTG
ttatcctgctagctgtagaa

SEQ ID NO: 17074 - DNA, 20 bp, Artificial Sequence
  Description of Artificial Sequence: Synthetic oligonucleotide
  Target: SOD1; (+) strand; PAM type: YTN; PAM sequence: TTA
tcctgctagctgtagaaatg

SEQ ID NO: 17075 - DNA, 20 bp, Artificial Sequence
  Description of Artificial Sequence: Synthetic oligonucleotide
  Target: SOD1; (+) strand; PAM type: YTN; PAM sequence: CTG
ctagctgtagaaatgtatcc

SEQ ID NO: 17076 - DNA, 20 bp, Artificial Sequence
  Description of Artificial Sequence: Synthetic oligonucleotide
  Target: SOD1; (+) strand; PAM type: YTN; PAM sequence: CTA
gctgtagaaatgtatcctga

SEQ ID NO: 17077 - DNA, 20 bp, Artificial Sequence
  Description of Artificial Sequence: Synthetic oligonucleotide
  Target: SOD1; (+) strand; PAM type: YTN; PAM sequence: CTG
tagaaatgtatcctgataaa

SEQ ID NO: 17078 - DNA, 20 bp, Artificial Sequence
  Description of Artificial Sequence: Synthetic oligonucleotide
  Target: SOD1; (+) strand; PAM type: YTN; PAM sequence: CTG
ataaacattaaacactgtaa

SEQ ID NO: 17079 - DNA, 20 bp, Artificial Sequence
  Description of Artificial Sequence: Synthetic oligonucleotide
  Target: SOD1; (+) strand; PAM type: YTN; PAM sequence: TTA
aacactgtaatcttaaaagt

SEQ ID NO: 17080 - DNA, 20 bp, Artificial Sequence
  Description of Artificial Sequence: Synthetic oligonucleotide
  Target: SOD1; (+) strand; PAM type: YTN; PAM sequence: CTG
taatcttaaaagtgtaattg

SEQ ID NO: 17081 - DNA, 20 bp, Artificial Sequence
  Description of Artificial Sequence: Synthetic oligonucleotide
  Target: SOD1; (+) strand; PAM type: YTN; PAM sequence: CTT
aaaagtgtaattgtgtgact

SEQ ID NO: 17082 - DNA, 20 bp, Artificial Sequence
  Description of Artificial Sequence: Synthetic oligonucleotide
  Target: SOD1; (+) strand; PAM type: YTN; PAM sequence: TTA
aaagtgtaattgtgtgactt

SEQ ID NO: 17083 - DNA, 20 bp, Artificial Sequence
  Description of Artificial Sequence: Synthetic oligonucleotide
  Target: SOD1; (+) strand; PAM type: YTN; PAM sequence: TTG
tgtgactttttcagagttgc

SEQ ID NO: 17084 - DNA, 20 bp, Artificial Sequence
  Description of Artificial Sequence: Synthetic oligonucleotide
  Target: SOD1; (+) strand; PAM type: YTN; PAM sequence: CTT
tttcagagttgctttaaagt

SEQ ID NO: 17085 - DNA, 20 bp, Artificial Sequence
  Description of Artificial Sequence: Synthetic oligonucleotide
  Target: SOD1; (+) strand; PAM type: YTN; PAM sequence: TTT
ttcagagttgctttaaagta

SEQ ID NO: 17086 - DNA, 20 bp, Artificial Sequence
  Description of Artificial Sequence: Synthetic oligonucleotide
  Target: SOD1; (+) strand; PAM type: YTN; PAM sequence: TTT
tcagagttgctttaaagtac

SEQ ID NO: 17087 - DNA, 20 bp, Artificial Sequence
  Description of Artificial Sequence: Synthetic oligonucleotide
  Target: SOD1; (+) strand; PAM type: YTN; PAM sequence: TTT
cagagttgctttaaagtacc

SEQ ID NO: 17088 - DNA, 20 bp, Artificial Sequence
  Description of Artificial Sequence: Synthetic oligonucleotide
  Target: SOD1; (+) strand; PAM type: YTN; PAM sequence: TTC
agagttgctttaaagtacct

SEQ ID NO: 17089 - DNA, 20 bp, Artificial Sequence
  Description of Artificial Sequence: Synthetic oligonucleotide
  Target: SOD1; (+) strand; PAM type: YTN; PAM sequence: TTG
ctttaaagtacctgtagtga

SEQ ID NO: 17090 - DNA, 20 bp, Artificial Sequence
  Description of Artificial Sequence: Synthetic oligonucleotide
  Target: SOD1; (+) strand; PAM type: YTN; PAM sequence: CTT
taaagtacctgtagtgagaa

SEQ ID NO: 17091 - DNA, 20 bp, Artificial Sequence
  Description of Artificial Sequence: Synthetic oligonucleotide
  Target: SOD1; (+) strand; PAM type: YTN; PAM sequence: TTT
aaagtacctgtagtgagaaa

SEQ ID NO: 17092 - DNA, 20 bp, Artificial Sequence
  Description of Artificial Sequence: Synthetic oligonucleotide
  Target: SOD1; (+) strand; PAM type: YTN; PAM sequence: TTA
aagtacctgtagtgagaaac

SEQ ID NO: 17093 - DNA, 20 bp, Artificial Sequence
  Description of Artificial Sequence: Synthetic oligonucleotide
  Target: SOD1; (+) strand; PAM type: YTN; PAM sequence: CTG
tagtgagaaactgatttatg

SEQ ID NO: 17094 - DNA, 20 bp, Artificial Sequence
  Description of Artificial Sequence: Synthetic oligonucleotide
  Target: SOD1; (+) strand; PAM type: YTN; PAM sequence: CTG
atttatgatcacttggaaga

SEQ ID NO: 17095 - DNA, 20 bp, Artificial Sequence
  Description of Artificial Sequence: Synthetic oligonucleotide
  Target: SOD1; (+) strand; PAM type: YTN; PAM sequence: TTT
atgatcacttggaagatttg

SEQ ID NO: 17096 - DNA, 20 bp, Artificial Sequence
  Description of Artificial Sequence: Synthetic oligonucleotide
  Target: SOD1; (+) strand; PAM type: YTN; PAM sequence: TTA
tgatcacttggaagatttgt

SEQ ID NO: 17097 - DNA, 20 bp, Artificial Sequence
  Description of Artificial Sequence: Synthetic oligonucleotide
  Target: SOD1; (+) strand; PAM type: YTN; PAM sequence: CTT
ggaagatttgtatagtttta

SEQ ID NO: 17098 - DNA, 20 bp, Artificial Sequence
  Description of Artificial Sequence: Synthetic oligonucleotide
  Target: SOD1; (+) strand; PAM type: YTN; PAM sequence: TTG
gaagatttgtatagttttat

SEQ ID NO: 17099 - DNA, 20 bp, Artificial Sequence
  Description of Artificial Sequence: Synthetic oligonucleotide
  Target: SOD1; (+) strand; PAM type: YTN; PAM sequence: TTT
gtatagttttataaaactca

SEQ ID NO: 17100 - DNA, 20 bp, Artificial Sequence
  Description of Artificial Sequence: Synthetic oligonucleotide
  Target: SOD1; (+) strand; PAM type: YTN; PAM sequence: TTG
tatagttttataaaactcag

SEQ ID NO: 17101 - DNA, 20 bp, Artificial Sequence
  Description of Artificial Sequence: Synthetic oligonucleotide
  Target: SOD1; (+) strand; PAM type: YTN; PAM sequence: TTT
tataaaactcagttaaaatg

SEQ ID NO: 17102 - DNA, 20 bp, Artificial Sequence
  Description of Artificial Sequence: Synthetic oligonucleotide
  Target: SOD1; (+) strand; PAM type: YTN; PAM sequence: TTT
ataaaactcagttaaaatgt

SEQ ID NO: 17103 - DNA, 20 bp, Artificial Sequence
  Description of Artificial Sequence: Synthetic oligonucleotide
  Target: SOD1; (+) strand; PAM type: YTN; PAM sequence: TTA
taaaactcagttaaaatgtc

SEQ ID NO: 17104 - DNA, 20 bp, Artificial Sequence
  Description of Artificial Sequence: Synthetic oligonucleotide
  Target: SOD1; (+) strand; PAM type: YTN; PAM sequence: CTC
agttaaaatgtctgtttcaa

SEQ ID NO: 17105 - DNA, 20 bp, Artificial Sequence
  Description of Artificial Sequence: Synthetic oligonucleotide
  Target: SOD1; (+) strand; PAM type: YTN; PAM sequence: TTA
aaatgtctgtttcaatgacc

SEQ ID NO: 17106 - DNA, 20 bp, Artificial Sequence
  Description of Artificial Sequence: Synthetic oligonucleotide
  Target: SOD1; (+) strand; PAM type: YTN; PAM sequence: CTG
tttcaatgacctgtattttg

SEQ ID NO: 17107 - DNA, 20 bp, Artificial Sequence
  Description of Artificial Sequence: Synthetic oligonucleotide
  Target: SOD1; (+) strand; PAM type: YTN; PAM sequence: TTT
caatgacctgtattttgcca

SEQ ID NO: 17108 - DNA, 20 bp, Artificial Sequence
  Description of Artificial Sequence: Synthetic oligonucleotide
  Target: SOD1; (+) strand; PAM type: YTN; PAM sequence: TTC
aatgacctgtattttgccag

SEQ ID NO: 17109 - DNA, 20 bp, Artificial Sequence
  Description of Artificial Sequence: Synthetic oligonucleotide
  Target: SOD1; (+) strand; PAM type: YTN; PAM sequence: CTG
tattttgccagacttaaatc

SEQ ID NO: 17110 - DNA, 20 bp, Artificial Sequence
  Description of Artificial Sequence: Synthetic oligonucleotide
  Target: SOD1; (+) strand; PAM type: YTN; PAM sequence: TTT
tgccagacttaaatcacaga

SEQ ID NO: 17111 - DNA, 20 bp, Artificial Sequence
  Description of Artificial Sequence: Synthetic oligonucleotide
  Target: SOD1; (+) strand; PAM type: YTN; PAM sequence: TTT
gccagacttaaatcacagat

SEQ ID NO: 17112 - DNA, 20 bp, Artificial Sequence
  Description of Artificial Sequence: Synthetic oligonucleotide
  Target: SOD1; (+) strand; PAM type: YTN; PAM sequence: TTG
ccagacttaaatcacagatg

SEQ ID NO: 17113 - DNA, 20 bp, Artificial Sequence
  Description of Artificial Sequence: Synthetic oligonucleotide
  Target: SOD1; (+) strand; PAM type: YTN; PAM sequence: CTT
aaatcacagatgggtattaa

SEQ ID NO: 17114 - DNA, 20 bp, Artificial Sequence
  Description of Artificial Sequence: Synthetic oligonucleotide
  Target: SOD1; (+) strand; PAM type: YTN; PAM sequence: TTA
aatcacagatgggtattaaa

SEQ ID NO: 17115 - DNA, 20 bp, Artificial Sequence
  Description of Artificial Sequence: Synthetic oligonucleotide
  Target: SOD1; (+) strand; PAM type: YTN; PAM sequence: TTA
aacttgtcagaatttctttg

SEQ ID NO: 17116 - DNA, 20 bp, Artificial Sequence
  Description of Artificial Sequence: Synthetic oligonucleotide
  Target: SOD1; (+) strand; PAM type: YTN; PAM sequence: CTT
gtcagaatttctttgtcatt

SEQ ID NO: 17117 - DNA, 20 bp, Artificial Sequence
  Description of Artificial Sequence: Synthetic oligonucleotide
  Target: SOD1; (+) strand; PAM type: YTN; PAM sequence: TTG
tcagaatttctttgtcattc

SEQ ID NO: 17118 - DNA, 20 bp, Artificial Sequence
  Description of Artificial Sequence: Synthetic oligonucleotide
  Target: SOD1; (+) strand; PAM type: YTN; PAM sequence: TTT
ctttgtcattcaagcctgtg

SEQ ID NO: 17119 - DNA, 20 bp, Artificial Sequence
  Description of Artificial Sequence: Synthetic oligonucleotide
  Target: SOD1; (+) strand; PAM type: YTN; PAM sequence: TTC
tttgtcattcaagcctgtga

SEQ ID NO: 17120 - DNA, 20 bp, Artificial Sequence
  Description of Artificial Sequence: Synthetic oligonucleotide
  Target: SOD1; (+) strand; PAM type: YTN; PAM sequence: CTT
tgtcattcaagcctgtgaat

SEQ ID NO: 17121 - DNA, 20 bp, Artificial Sequence
  Description of Artificial Sequence: Synthetic oligonucleotide
  Target: SOD1; (+) strand; PAM type: YTN; PAM sequence: TTT
gtcattcaagcctgtgaata

SEQ ID NO: 17122 - DNA, 20 bp, Artificial Sequence
  Description of Artificial Sequence: Synthetic oligonucleotide
  Target: SOD1; (+) strand; PAM type: YTN; PAM sequence: TTG
tcattcaagcctgtgaataa

SEQ ID NO: 17123 - DNA, 20 bp, Artificial Sequence
  Description of Artificial Sequence: Synthetic oligonucleotide
  Target: SOD1; (+) strand; PAM type: YTN; PAM sequence: TTC
aagcctgtgaataaaaaccc

SEQ ID NO: 17124 - DNA, 20 bp, Artificial Sequence
  Description of Artificial Sequence: Synthetic oligonucleotide
  Target: SOD1; (+) strand; PAM type: YTN; PAM sequence: CTG
tgaataaaaaccctgtatgg

SEQ ID NO: 17125 - DNA, 20 bp, Artificial Sequence
  Description of Artificial Sequence: Synthetic oligonucleotide
  Target: SOD1; (+) strand; PAM type: YTN; PAM sequence: CTG
tatggcacttattatgaggc

SEQ ID NO: 17126 - DNA, 20 bp, Artificial Sequence
  Description of Artificial Sequence: Synthetic oligonucleotide
  Target: SOD1; (+) strand; PAM type: YTN; PAM sequence: CTT
attatgaggctattaaaaga

SEQ ID NO: 17127 - DNA, 20 bp, Artificial Sequence
  Description of Artificial Sequence: Synthetic oligonucleotide
  Target: SOD1; (+) strand; PAM type: YTN; PAM sequence: TTA
ttatgaggctattaaaagaa

SEQ ID NO: 17128 - DNA, 20 bp, Artificial Sequence
  Description of Artificial Sequence: Synthetic oligonucleotide
  Target: SOD1; (+) strand; PAM type: YTN; PAM sequence: TTA
tgaggctattaaaagaatcc

SEQ ID NO: 17129 - DNA, 20 bp, Artificial Sequence
  Description of Artificial Sequence: Synthetic oligonucleotide
  Target: SOD1; (+) strand; PAM type: YTN; PAM sequence: CTA
ttaaaagaatccaaattcaa

SEQ ID NO: 17130 - DNA, 20 bp, Artificial Sequence
  Description of Artificial Sequence: Synthetic oligonucleotide
  Target: SOD1; (+) strand; PAM type: YTN; PAM sequence: TTA
aaagaatccaaattcaaact

SEQ ID NO: 17131 - DNA, 20 bp, Artificial Sequence
  Description of Artificial Sequence: Synthetic oligonucleotide
  Target: SOD1; (+) strand; PAM type: YTN; PAM sequence: TTC
aaactaaattagctctgata

SEQ ID NO: 17132 - DNA, 20 bp, Artificial Sequence
  Description of Artificial Sequence: Synthetic oligonucleotide
  Target: SOD1; (+) strand; PAM type: YTN; PAM sequence: CTA
aattagctctgatacttatt

SEQ ID NO: 17133 - DNA, 20 bp, Artificial Sequence
  Description of Artificial Sequence: Synthetic oligonucleotide
  Target: SOD1; (+) strand; PAM type: YTN; PAM sequence: TTA
gctctgatacttatttatat

SEQ ID NO: 17134 - DNA, 20 bp, Artificial Sequence
  Description of Artificial Sequence: Synthetic oligonucleotide
  Target: SOD1; (+) strand; PAM type: YTN; PAM sequence: CTC
tgatacttatttatataaac

SEQ ID NO: 17135 - DNA, 20 bp, Artificial Sequence
  Description of Artificial Sequence: Synthetic oligonucleotide
  Target: SOD1; (+) strand; PAM type: YTN; PAM sequence: CTG
atacttatttatataaacag

SEQ ID NO: 17136 - DNA, 20 bp, Artificial Sequence
  Description of Artificial Sequence: Synthetic oligonucleotide
  Target: SOD1; (+) strand; PAM type: YTN; PAM sequence: CTT
atttatataaacagcttcag

SEQ ID NO: 17137 - DNA, 20 bp, Artificial Sequence
  Description of Artificial Sequence: Synthetic oligonucleotide
  Target: SOD1; (+) strand; PAM type: YTN; PAM sequence: TTA
tttatataaacagcttcagt

SEQ ID NO: 17138 - DNA, 20 bp, Artificial Sequence
  Description of Artificial Sequence: Synthetic oligonucleotide
  Target: SOD1; (+) strand; PAM type: YTN; PAM sequence: TTT
atataaacagcttcagtgga

SEQ ID NO: 17139 - DNA, 20 bp, Artificial Sequence
  Description of Artificial Sequence: Synthetic oligonucleotide
  Target: SOD1; (+) strand; PAM type: YTN; PAM sequence: TTA
tataaacagcttcagtggaa

SEQ ID NO: 17140 - DNA, 20 bp, Artificial Sequence
  Description of Artificial Sequence: Synthetic oligonucleotide
  Target: SOD1; (+) strand; PAM type: YTN; PAM sequence: CTT
cagtggaacagatttagtaa

SEQ ID NO: 17141 - DNA, 20 bp, Artificial Sequence
  Description of Artificial Sequence: Synthetic oligonucleotide
  Target: SOD1; (+) strand; PAM type: YTN; PAM sequence: TTC
agtggaacagatttagtaat

SEQ ID NO: 17142 - DNA, 20 bp, Artificial Sequence
  Description of Artificial Sequence: Synthetic oligonucleotide
  Target: SOD1; (+) strand; PAM type: YTN; PAM sequence: TTT
agtaatactaacagtgatag

SEQ ID NO: 17143 - DNA, 20 bp, Artificial Sequence
  Description of Artificial Sequence: Synthetic oligonucleotide
  Target: SOD1; (+) strand; PAM type: YTN; PAM sequence: TTA
gtaatactaacagtgatagc

SEQ ID NO: 17144 - DNA, 20 bp, Artificial Sequence
  Description of Artificial Sequence: Synthetic oligonucleotide
  Target: SOD1; (+) strand; PAM type: YTN; PAM sequence: CTA
acagtgatagcattttattt

SEQ ID NO: 17145 - DNA, 20 bp, Artificial Sequence
  Description of Artificial Sequence: Synthetic oligonucleotide
  Target: SOD1; (+) strand; PAM type: YTN; PAM sequence: TTT
tattttgaaagtgttttgag

SEQ ID NO: 17146 - DNA, 20 bp, Artificial Sequence
  Description of Artificial Sequence: Synthetic oligonucleotide
  Target: SOD1; (+) strand; PAM type: YTN; PAM sequence: TTT
attttgaaagtgttttgaga

SEQ ID NO: 17147 - DNA, 20 bp, Artificial Sequence
  Description of Artificial Sequence: Synthetic oligonucleotide
  Target: SOD1; (+) strand; PAM type: YTN; PAM sequence: TTA
ttttgaaagtgttttgagac

SEQ ID NO: 17148 - DNA, 20 bp, Artificial Sequence
  Description of Artificial Sequence: Synthetic oligonucleotide
  Target: SOD1; (+) strand; PAM type: YTN; PAM sequence: TTT
tgaaagtgttttgagaccat

SEQ ID NO: 17149 - DNA, 20 bp, Artificial Sequence
  Description of Artificial Sequence: Synthetic oligonucleotide
  Target: SOD1; (+) strand; PAM type: YTN; PAM sequence: TTT
gaaagtgttttgagaccatc

SEQ ID NO: 17150 - DNA, 20 bp, Artificial Sequence
  Description of Artificial Sequence: Synthetic oligonucleotide
  Target: SOD1; (+) strand; PAM type: YTN; PAM sequence: TTG
aaagtgttttgagaccatca

SEQ ID NO: 17151 - DNA, 20 bp, Artificial Sequence
  Description of Artificial Sequence: Synthetic oligonucleotide
  Target: SOD1; (+) strand; PAM type: YTN; PAM sequence: TTT
tgagaccatcaaaatgcata

SEQ ID NO: 17152 - DNA, 20 bp, Artificial Sequence
  Description of Artificial Sequence: Synthetic oligonucleotide
  Target: SOD1; (+) strand; PAM type: YTN; PAM sequence: TTT
gagaccatcaaaatgcatac

SEQ ID NO: 17153 - DNA, 20 bp, Artificial Sequence
  Description of Artificial Sequence: Synthetic oligonucleotide
  Target: SOD1; (+) strand; PAM type: YTN; PAM sequence: TTG
agaccatcaaaatgcatact

SEQ ID NO: 17154 - DNA, 20 bp, Artificial Sequence
  Description of Artificial Sequence: Synthetic oligonucleotide
  Target: SOD1; (+) strand; PAM type: YTN; PAM sequence: CTT
taaaacagcaggtcttttag

SEQ ID NO: 17155 - DNA, 20 bp, Artificial Sequence
  Description of Artificial Sequence: Synthetic oligonucleotide
  Target: SOD1; (+) strand; PAM type: YTN; PAM sequence: TTT
aaaacagcaggtcttttagc

SEQ ID NO: 17156 - DNA, 20 bp, Artificial Sequence
  Description of Artificial Sequence: Synthetic oligonucleotide
  Target: SOD1; (+) strand; PAM type: YTN; PAM sequence: TTA
aaacagcaggtcttttagct

SEQ ID NO: 17157 - DNA, 20 bp, Artificial Sequence
  Description of Artificial Sequence: Synthetic oligonucleotide
  Target: SOD1; (+) strand; PAM type: YTN; PAM sequence: CTT
ttagctaaaactaacacaac

SEQ ID NO: 17158 - DNA, 20 bp, Artificial Sequence
  Description of Artificial Sequence: Synthetic oligonucleotide
  Target: SOD1; (+) strand; PAM type: YTN; PAM sequence: TTT
tagctaaaactaacacaact

SEQ ID NO: 17159 - DNA, 20 bp, Artificial Sequence
  Description of Artificial Sequence: Synthetic oligonucleotide
  Target: SOD1; (+) strand; PAM type: YTN; PAM sequence: TTT
agctaaaactaacacaactc

SEQ ID NO: 17160 - DNA, 20 bp, Artificial Sequence
  Description of Artificial Sequence: Synthetic oligonucleotide
  Target: SOD1; (+) strand; PAM type: YTN; PAM sequence: TTA
gctaaaactaacacaactct

SEQ ID NO: 17161 - DNA, 20 bp, Artificial Sequence
  Description of Artificial Sequence: Synthetic oligonucleotide
  Target: SOD1; (+) strand; PAM type: YTN; PAM sequence: CTA
aaactaacacaactctgctt

SEQ ID NO: 17162 - DNA, 20 bp, Artificial Sequence
  Description of Artificial Sequence: Synthetic oligonucleotide
  Target: SOD1; (+) strand; PAM type: YTN; PAM sequence: CTA
acacaactctgcttagacaa

SEQ ID NO: 17163 - DNA, 20 bp, Artificial Sequence
  Description of Artificial Sequence: Synthetic oligonucleotide
  Target: SOD1; (+) strand; PAM type: YTN; PAM sequence: CTC
tgcttagacaaataggctgt

SEQ ID NO: 17164 - DNA, 20 bp, Artificial Sequence
  Description of Artificial Sequence: Synthetic oligonucleotide
  Target: SOD1; (+) strand; PAM type: YTN; PAM sequence: CTG
cttagacaaataggctgtcc

SEQ ID NO: 17165 - DNA, 20 bp, Artificial Sequence
  Description of Artificial Sequence: Synthetic oligonucleotide
  Target: SOD1; (+) strand; PAM type: YTN; PAM sequence: CTT
agacaaataggctgtccttt

SEQ ID NO: 17166 - DNA, 20 bp, Artificial Sequence
  Description of Artificial Sequence: Synthetic oligonucleotide
  Target: SOD1; (+) strand; PAM type: YTN; PAM sequence: TTA
gacaaataggctgtcctttg

SEQ ID NO: 17167 - DNA, 20 bp, Artificial Sequence
  Description of Artificial Sequence: Synthetic oligonucleotide
  Target: SOD1; (+) strand; PAM type: YTN; PAM sequence: CTG
tcctttgaaagctttaggga

SEQ ID NO: 17168 - DNA, 20 bp, Artificial Sequence
  Description of Artificial Sequence: Synthetic oligonucleotide
  Target: SOD1; (+) strand; PAM type: YTN; PAM sequence: CTT
tgaaagctttagggaaatgt

SEQ ID NO: 17169 - DNA, 20 bp, Artificial Sequence
  Description of Artificial Sequence: Synthetic oligonucleotide
  Target: SOD1; (+) strand; PAM type: YTN; PAM sequence: TTT
gaaagctttagggaaatgtt

SEQ ID NO: 17170 - DNA, 20 bp, Artificial Sequence
  Description of Artificial Sequence: Synthetic oligonucleotide
  Target: SOD1; (+) strand; PAM type: YTN; PAM sequence: TTG
aaagctttagggaaatgttc

SEQ ID NO: 17171 - DNA, 20 bp, Artificial Sequence
  Description of Artificial Sequence: Synthetic oligonucleotide
  Target: SOD1; (+) strand; PAM type: YTN; PAM sequence: CTT
tagggaaatgttcctgctta

SEQ ID NO: 17172 - DNA, 20 bp, Artificial Sequence
  Description of Artificial Sequence: Synthetic oligonucleotide
  Target: SOD1; (+) strand; PAM type: YTN; PAM sequence: TTT
agggaaatgttcctgcttag

SEQ ID NO: 17173 - DNA, 20 bp, Artificial Sequence
  Description of Artificial Sequence: Synthetic oligonucleotide
  Target: SOD1; (+) strand; PAM type: YTN; PAM sequence: TTA
gggaaatgttcctgcttagt

SEQ ID NO: 17174 - DNA, 20 bp, Artificial Sequence
  Description of Artificial Sequence: Synthetic oligonucleotide
  Target: SOD1; (+) strand; PAM type: YTN; PAM sequence: TTC
ctgcttagtcattttagcat

SEQ ID NO: 17175 - DNA, 20 bp, Artificial Sequence
  Description of Artificial Sequence: Synthetic oligonucleotide
  Target: SOD1; (+) strand; PAM type: YTN; PAM sequence: CTG
cttagtcattttagcatttt

SEQ ID NO: 17176 - DNA, 20 bp, Artificial Sequence
  Description of Artificial Sequence: Synthetic oligonucleotide
  Target: SOD1; (+) strand; PAM type: YTN; PAM sequence: CTT
agtcattttagcattttgat

SEQ ID NO: 17177 - DNA, 20 bp, Artificial Sequence
  Description of Artificial Sequence: Synthetic oligonucleotide
  Target: SOD1; (+) strand; PAM type: YTN; PAM sequence: TTA
gtcattttagcattttgatt

SEQ ID NO: 17178 - DNA, 20 bp, Artificial Sequence
  Description of Artificial Sequence: Synthetic oligonucleotide
  Target: SOD1; (+) strand; PAM type: YTN; PAM sequence: TTT
tagcattttgattcataaag

SEQ ID NO: 17179 - DNA, 20 bp, Artificial Sequence
  Description of Artificial Sequence: Synthetic oligonucleotide
  Target: SOD1; (+) strand; PAM type: YTN; PAM sequence: TTT
agcattttgattcataaagt

SEQ ID NO: 17180 - DNA, 20 bp, Artificial Sequence
  Description of Artificial Sequence: Synthetic oligonucleotide
  Target: SOD1; (+) strand; PAM type: YTN; PAM sequence: TTA
gcattttgattcataaagta

SEQ ID NO: 17181 - DNA, 20 bp, Artificial Sequence
  Description of Artificial Sequence: Synthetic oligonucleotide
  Target: SOD1; (+) strand; PAM type: YTN; PAM sequence: TTT
tgattcataaagtacctcct

SEQ ID NO: 17182 - DNA, 20 bp, Artificial Sequence
  Description of Artificial Sequence: Synthetic oligonucleotide
  Target: SOD1; (+) strand; PAM type: YTN; PAM sequence: TTT
gattcataaagtacctcctc

SEQ ID NO: 17183 - DNA, 20 bp, Artificial Sequence
  Description of Artificial Sequence: Synthetic oligonucleotide
  Target: SOD1; (+) strand; PAM type: YTN; PAM sequence: TTG
attcataaagtacctcctca

SEQ ID NO: 17184 - DNA, 20 bp, Artificial Sequence
  Description of Artificial Sequence: Synthetic oligonucleotide
  Target: SOD1; (+) strand; PAM type: YTN; PAM sequence: TTC
ataaagtacctcctcatttt

SEQ ID NO: 17185 - DNA, 20 bp, Artificial Sequence
  Description of Artificial Sequence: Synthetic oligonucleotide
  Target: SOD1; (+) strand; PAM type: YTN; PAM sequence: CTC
ctcattttaaaaagacatta

SEQ ID NO: 17186 - DNA, 20 bp, Artificial Sequence
  Description of Artificial Sequence: Synthetic oligonucleotide
  Target: SOD1; (+) strand; PAM type: YTN; PAM sequence: CTC
attttaaaaagacattatga

SEQ ID NO: 17187 - DNA, 20 bp, Artificial Sequence
  Description of Artificial Sequence: Synthetic oligonucleotide
  Target: SOD1; (+) strand; PAM type: YTN; PAM sequence: TTT
taaaaagacattatgatgta

SEQ ID NO: 17188 - DNA, 20 bp, Artificial Sequence
  Description of Artificial Sequence: Synthetic oligonucleotide
  Target: SOD1; (+) strand; PAM type: YTN; PAM sequence: TTT
aaaaagacattatgatgtaa

SEQ ID NO: 17189 - DNA, 20 bp, Artificial Sequence
  Description of Artificial Sequence: Synthetic oligonucleotide
  Target: SOD1; (+) strand; PAM type: YTN; PAM sequence: TTA
aaaagacattatgatgtaag

SEQ ID NO: 17190 - DNA, 20 bp, Artificial Sequence
  Description of Artificial Sequence: Synthetic oligonucleotide
  Target: SOD1; (+) strand; PAM type: YTN; PAM sequence: TTA
tgatgtaagagagccatttg

SEQ ID NO: 17191 - DNA, 20 bp, Artificial Sequence
  Description of Artificial Sequence: Synthetic oligonucleotide
  Target: SOD1; (+) strand; PAM type: YTN; PAM sequence: TTT
gataactttttagtgagctt

SEQ ID NO: 17192 - DNA, 20 bp, Artificial Sequence
  Description of Artificial Sequence: Synthetic oligonucleotide
  Target: SOD1; (+) strand; PAM type: YTN; PAM sequence: TTG
ataactttttagtgagcttt

SEQ ID NO: 17193 - DNA, 20 bp, Artificial Sequence
  Description of Artificial Sequence: Synthetic oligonucleotide
  Target: SOD1; (+) strand; PAM type: YTN; PAM sequence: CTT
tttagtgagctttgaaaggc

SEQ ID NO: 17194 - DNA, 20 bp, Artificial Sequence
  Description of Artificial Sequence: Synthetic oligonucleotide
  Target: SOD1; (+) strand; PAM type: YTN; PAM sequence: TTT
ttagtgagctttgaaaggca

SEQ ID NO: 17195 - DNA, 20 bp, Artificial Sequence
  Description of Artificial Sequence: Synthetic oligonucleotide
  Target: SOD1; (+) strand; PAM type: YTN; PAM sequence: TTT
tagtgagctttgaaaggcaa

SEQ ID NO: 17196 - DNA, 20 bp, Artificial Sequence
  Description of Artificial Sequence: Synthetic oligonucleotide
  Target: SOD1; (+) strand; PAM type: YTN; PAM sequence: TTT
agtgagctttgaaaggcaag

SEQ ID NO: 17197 - DNA, 20 bp, Artificial Sequence
  Description of Artificial Sequence: Synthetic oligonucleotide
  Target: SOD1; (+) strand; PAM type: YTN; PAM sequence: TTA
gtgagctttgaaaggcaagt

SEQ ID NO: 17198 - DNA, 20 bp, Artificial Sequence
  Description of Artificial Sequence: Synthetic oligonucleotide
  Target: SOD1; (+) strand; PAM type: YTN; PAM sequence: CTT
tgaaaggcaagttacagcct

SEQ ID NO: 17199 - DNA, 20 bp, Artificial Sequence
  Description of Artificial Sequence: Synthetic oligonucleotide
  Target: SOD1; (+) strand; PAM type: YTN; PAM sequence: TTT
gaaaggcaagttacagcctc

SEQ ID NO: 17200 - DNA, 20 bp, Artificial Sequence
  Description of Artificial Sequence: Synthetic oligonucleotide
  Target: SOD1; (+) strand; PAM type: YTN; PAM sequence: TTG
aaaggcaagttacagcctca

SEQ ID NO: 17201 - DNA, 20 bp, Artificial Sequence
  Description of Artificial Sequence: Synthetic oligonucleotide
  Target: SOD1; (+) strand; PAM type: YTN; PAM sequence: TTA
cagcctcagctagctagtaa

SEQ ID NO: 17202 - DNA, 20 bp, Artificial Sequence
  Description of Artificial Sequence: Synthetic oligonucleotide
  Target: SOD1; (+) strand; PAM type: YTN; PAM sequence: CTC
agctagctagtaagattatc

SEQ ID NO: 17203 - DNA, 20 bp, Artificial Sequence
  Description of Artificial Sequence: Synthetic oligonucleotide
  Target: SOD1; (+) strand; PAM type: YTN; PAM sequence: CTA
gctagtaagattatctacct

SEQ ID NO: 17204 - DNA, 20 bp, Artificial Sequence
  Description of Artificial Sequence: Synthetic oligonucleotide
  Target: SOD1; (+) strand; PAM type: YTN; PAM sequence: CTA
gtaagattatctacctgcca

SEQ ID NO: 17205 - DNA, 20 bp, Artificial Sequence
  Description of Artificial Sequence: Synthetic oligonucleotide
  Target: SOD1; (+) strand; PAM type: YTN; PAM sequence: TTA
tctacctgccagaatggcac

SEQ ID NO: 17206 - DNA, 20 bp, Artificial Sequence
  Description of Artificial Sequence: Synthetic oligonucleotide
  Target: SOD1; (+) strand; PAM type: YTN; PAM sequence: CTA
cctgccagaatggcacaaat

SEQ ID NO: 17207 - DNA, 20 bp, Artificial Sequence
  Description of Artificial Sequence: Synthetic oligonucleotide
  Target: SOD1; (+) strand; PAM type: YTN; PAM sequence: CTG
ccagaatggcacaaattcta

SEQ ID NO: 17208 - DNA, 20 bp, Artificial Sequence
  Description of Artificial Sequence: Synthetic oligonucleotide
  Target: SOD1; (+) strand; PAM type: YTN; PAM sequence: TTC
tacattcaagggtagacgct

SEQ ID NO: 17209 - DNA, 20 bp, Artificial Sequence
  Description of Artificial Sequence: Synthetic oligonucleotide
  Target: SOD1; (+) strand; PAM type: YTN; PAM sequence: CTA
cattcaagggtagacgctgg

SEQ ID NO: 17210 - DNA, 20 bp, Artificial Sequence
  Description of Artificial Sequence: Synthetic oligonucleotide
  Target: SOD1; (+) strand; PAM type: YTN; PAM sequence: TTC
aagggtagacgctggcacaa

SEQ ID NO: 17211 - DNA, 20 bp, Artificial Sequence
  Description of Artificial Sequence: Synthetic oligonucleotide
  Target: SOD1; (+) strand; PAM type: YTN; PAM sequence: CTG
gcacaacctacttacagatt

SEQ ID NO: 17212 - DNA, 20 bp, Artificial Sequence
  Description of Artificial Sequence: Synthetic oligonucleotide
  Target: SOD1; (+) strand; PAM type: YTN; PAM sequence: CTA
cttacagattagccctttaa

SEQ ID NO: 17213 - DNA, 20 bp, Artificial Sequence
  Description of Artificial Sequence: Synthetic oligonucleotide
  Target: SOD1; (+) strand; PAM type: YTN; PAM sequence: CTT
acagattagccctttaaagc

SEQ ID NO: 17214 - DNA, 20 bp, Artificial Sequence
  Description of Artificial Sequence: Synthetic oligonucleotide
  Target: SOD1; (+) strand; PAM type: YTN; PAM sequence: TTA
cagattagccctttaaagca

SEQ ID NO: 17215 - DNA, 20 bp, Artificial Sequence
  Description of Artificial Sequence: Synthetic oligonucleotide
  Target: SOD1; (+) strand; PAM type: YTN; PAM sequence: TTA
gccctttaaagcaatctgta

SEQ ID NO: 17216 - DNA, 20 bp, Artificial Sequence
  Description of Artificial Sequence: Synthetic oligonucleotide
  Target: SOD1; (+) strand; PAM type: YTN; PAM sequence: CTT
taaagcaatctgtagcatta

SEQ ID NO: 17217 - DNA, 20 bp, Artificial Sequence
  Description of Artificial Sequence: Synthetic oligonucleotide
  Target: SOD1; (+) strand; PAM type: YTN; PAM sequence: TTT
aaagcaatctgtagcattag

SEQ ID NO: 17218 - DNA, 20 bp, Artificial Sequence
  Description of Artificial Sequence: Synthetic oligonucleotide
  Target: SOD1; (+) strand; PAM type: YTN; PAM sequence: TTA
aagcaatctgtagcattaga

SEQ ID NO: 17219 - DNA, 20 bp, Artificial Sequence
  Description of Artificial Sequence: Synthetic oligonucleotide
  Target: SOD1; (+) strand; PAM type: YTN; PAM sequence: CTG
tagcattagaagatggaacc

SEQ ID NO: 17220 - DNA, 20 bp, Artificial Sequence
  Description of Artificial Sequence: Synthetic oligonucleotide
  Target: SOD1; (+) strand; PAM type: YTN; PAM sequence: TTA
gaagatggaaccaaggaaat

SEQ ID NO: 17221 - DNA, 20 bp, Artificial Sequence
  Description of Artificial Sequence: Synthetic oligonucleotide
  Target: SOD1; (+) strand; PAM type: YTN; PAM sequence: TTT
gactgtgggttctggctgtt

SEQ ID NO: 17222 - DNA, 20 bp, Artificial Sequence
  Description of Artificial Sequence: Synthetic oligonucleotide
  Target: SOD1; (+) strand; PAM type: YTN; PAM sequence: TTG
actgtgggttctggctgttg

SEQ ID NO: 17223 - DNA, 20 bp, Artificial Sequence
  Description of Artificial Sequence: Synthetic oligonucleotide
  Target: SOD1; (+) strand; PAM type: YTN; PAM sequence: CTG
tgggttctggctgttgagaa

SEQ ID NO: 17224 - DNA, 20 bp, Artificial Sequence
  Description of Artificial Sequence: Synthetic oligonucleotide
  Target: SOD1; (+) strand; PAM type: YTN; PAM sequence: TTC
tggctgttgagaaataattt

SEQ ID NO: 17225 - DNA, 20 bp, Artificial Sequence
  Description of Artificial Sequence: Synthetic oligonucleotide
  Target: SOD1; (+) strand; PAM type: YTN; PAM sequence: CTG
gctgttgagaaataatttac

SEQ ID NO: 17226 - DNA, 20 bp, Artificial Sequence
  Description of Artificial Sequence: Synthetic oligonucleotide
  Target: SOD1; (+) strand; PAM type: YTN; PAM sequence: CTG
ttgagaaataatttacacac

SEQ ID NO: 17227 - DNA, 20 bp, Artificial Sequence
  Description of Artificial Sequence: Synthetic oligonucleotide
  Target: SOD1; (+) strand; PAM type: YTN; PAM sequence: TTG
agaaataatttacacaccga

SEQ ID NO: 17228 - DNA, 20 bp, Artificial Sequence
  Description of Artificial Sequence: Synthetic oligonucleotide
  Target: SOD1; (+) strand; PAM type: YTN; PAM sequence: TTT
acacaccgaattagtgaaat

SEQ ID NO: 17229 - DNA, 20 bp, Artificial Sequence
  Description of Artificial Sequence: Synthetic oligonucleotide
  Target: SOD1; (+) strand; PAM type: YTN; PAM sequence: TTA
cacaccgaattagtgaaatg

SEQ ID NO: 17230 - DNA, 20 bp, Artificial Sequence
  Description of Artificial Sequence: Synthetic oligonucleotide
  Target: SOD1; (+) strand; PAM type: YTN; PAM sequence: TTA
gtgaaatgagtcactttctc

SEQ ID NO: 17231 - DNA, 20 bp, Artificial Sequence
  Description of Artificial Sequence: Synthetic oligonucleotide
  Target: SOD1; (+) strand; PAM type: YTN; PAM sequence: CTT
tctcttaatgtatttatgta

SEQ ID NO: 17232 - DNA, 20 bp, Artificial Sequence
  Description of Artificial Sequence: Synthetic oligonucleotide
  Target: SOD1; (+) strand; PAM type: YTN; PAM sequence: TTT
ctcttaatgtatttatgtac

SEQ ID NO: 17233 - DNA, 20 bp, Artificial Sequence
  Description of Artificial Sequence: Synthetic oligonucleotide
  Target: SOD1; (+) strand; PAM type: YTN; PAM sequence: TTC
tcttaatgtatttatgtacc

SEQ ID NO: 17234 - DNA, 20 bp, Artificial Sequence
  Description of Artificial Sequence: Synthetic oligonucleotide
  Target: SOD1; (+) strand; PAM type: YTN; PAM sequence: CTC
ttaatgtatttatgtacctg

SEQ ID NO: 17235 - DNA, 20 bp, Artificial Sequence
  Description of Artificial Sequence: Synthetic oligonucleotide
  Target: SOD1; (+) strand; PAM type: YTN; PAM sequence: CTT
aatgtatttatgtacctgag

SEQ ID NO: 17236 - DNA, 20 bp, Artificial Sequence
  Description of Artificial Sequence: Synthetic oligonucleotide
  Target: SOD1; (+) strand; PAM type: YTN; PAM sequence: TTA
atgtatttatgtacctgaga

SEQ ID NO: 17237 - DNA, 20 bp, Artificial Sequence
  Description of Artificial Sequence: Synthetic oligonucleotide
  Target: SOD1; (+) strand; PAM type: YTN; PAM sequence: TTT
atgtacctgagagaatgctt

SEQ ID NO: 17238 - DNA, 20 bp, Artificial Sequence
  Description of Artificial Sequence: Synthetic oligonucleotide
  Target: SOD1; (+) strand; PAM type: YTN; PAM sequence: TTA
tgtacctgagagaatgcttt

SEQ ID NO: 17239 - DNA, 20 bp, Artificial Sequence
  Description of Artificial Sequence: Synthetic oligonucleotide
  Target: SOD1; (+) strand; PAM type: YTN; PAM sequence: CTG
agagaatgcttttcaatgtt

SEQ ID NO: 17240 - DNA, 20 bp, Artificial Sequence
  Description of Artificial Sequence: Synthetic oligonucleotide
  Target: SOD1; (+) strand; PAM type: YTN; PAM sequence: CTT
ttcaatgttaacctaactca

SEQ ID NO: 17241 - DNA, 20 bp, Artificial Sequence
  Description of Artificial Sequence: Synthetic oligonucleotide
  Target: SOD1; (+) strand; PAM type: YTN; PAM sequence: TTT
tcaatgttaacctaactcag

SEQ ID NO: 17242 - DNA, 20 bp, Artificial Sequence
  Description of Artificial Sequence: Synthetic oligonucleotide
  Target: SOD1; (+) strand; PAM type: YTN; PAM sequence: TTT
caatgttaacctaactcagg

SEQ ID NO: 17243 - DNA, 20 bp, Artificial Sequence
  Description of Artificial Sequence: Synthetic oligonucleotide
  Target: SOD1; (+) strand; PAM type: YTN; PAM sequence: TTC
aatgttaacctaactcaggt

SEQ ID NO: 17244 - DNA, 20 bp, Artificial Sequence
  Description of Artificial Sequence: Synthetic oligonucleotide
  Target: SOD1; (+) strand; PAM type: YTN; PAM sequence: TTA
acctaactcaggtttgacta

SEQ ID NO: 17245 - DNA, 20 bp, Artificial Sequence
  Description of Artificial Sequence: Synthetic oligonucleotide
  Target: SOD1; (+) strand; PAM type: YTN; PAM sequence: CTA
actcaggtttgactaaatta

SEQ ID NO: 17246 - DNA, 20 bp, Artificial Sequence
  Description of Artificial Sequence: Synthetic oligonucleotide
  Target: SOD1; (+) strand; PAM type: YTN; PAM sequence: CTC
aggtttgactaaattattca

SEQ ID NO: 17247 - DNA, 20 bp, Artificial Sequence
  Description of Artificial Sequence: Synthetic oligonucleotide
  Target: SOD1; (+) strand; PAM type: YTN; PAM sequence: TTT
gactaaattattcaattgga

SEQ ID NO: 17248 - DNA, 20 bp, Artificial Sequence
  Description of Artificial Sequence: Synthetic oligonucleotide
  Target: SOD1; (+) strand; PAM type: YTN; PAM sequence: TTG
actaaattattcaattggaa

SEQ ID NO: 17249 - DNA, 20 bp, Artificial Sequence
  Description of Artificial Sequence: Synthetic oligonucleotide
  Target: SOD1; (+) strand; PAM type: YTN; PAM sequence: CTA
aattattcaattggaaattg

SEQ ID NO: 17250 - DNA, 20 bp, Artificial Sequence
  Description of Artificial Sequence: Synthetic oligonucleotide
  Target: SOD1; (+) strand; PAM type: YTN; PAM sequence: TTA
ttcaattggaaattgtagaa

SEQ ID NO: 17251 - DNA, 20 bp, Artificial Sequence
  Description of Artificial Sequence: Synthetic oligonucleotide
  Target: SOD1; (+) strand; PAM type: YTN; PAM sequence: TTC
aattggaaattgtagaatat

SEQ ID NO: 17252 - DNA, 20 bp, Artificial Sequence
  Description of Artificial Sequence: Synthetic oligonucleotide
  Target: SOD1; (+) strand; PAM type: YTN; PAM sequence: TTG
gaaattgtagaatattattt

SEQ ID NO: 17253 - DNA, 20 bp, Artificial Sequence
  Description of Artificial Sequence: Synthetic oligonucleotide
  Target: SOD1; (+) strand; PAM type: YTN; PAM sequence: TTG
tagaatattatttctgataa

SEQ ID NO: 17254 - DNA, 20 bp, Artificial Sequence
  Description of Artificial Sequence: Synthetic oligonucleotide
  Target: SOD1; (+) strand; PAM type: YTN; PAM sequence: TTA
tttctgataaaccagaaata

SEQ ID NO: 17255 - DNA, 20 bp, Artificial Sequence
  Description of Artificial Sequence: Synthetic oligonucleotide
  Target: SOD1; (+) strand; PAM type: YTN; PAM sequence: TTT
ctgataaaccagaaataagt

SEQ ID NO: 17256 - DNA, 20 bp, Artificial Sequence
  Description of Artificial Sequence: Synthetic oligonucleotide
  Target: SOD1; (+) strand; PAM type: YTN; PAM sequence: TTC
tgataaaccagaaataagtg

SEQ ID NO: 17257 - DNA, 20 bp, Artificial Sequence
  Description of Artificial Sequence: Synthetic oligonucleotide
  Target: SOD1; (+) strand; PAM type: YTN; PAM sequence: CTG
ataaaccagaaataagtgaa

SEQ ID NO: 17258 - DNA, 20 bp, Artificial Sequence
  Description of Artificial Sequence: Synthetic oligonucleotide
  Target: SOD1; (+) strand; PAM type: YTN; PAM sequence: CTG
tttgttcataaatatgtact

SEQ ID NO: 17259 - DNA, 20 bp, Artificial Sequence
  Description of Artificial Sequence: Synthetic oligonucleotide
  Target: SOD1; (+) strand; PAM type: YTN; PAM sequence: TTT
gttcataaatatgtacttta

SEQ ID NO: 17260 - DNA, 20 bp, Artificial Sequence
  Description of Artificial Sequence: Synthetic oligonucleotide
  Target: SOD1; (+) strand; PAM type: YTN; PAM sequence: TTG
ttcataaatatgtactttat

SEQ ID NO: 17261 - DNA, 20 bp, Artificial Sequence
  Description of Artificial Sequence: Synthetic oligonucleotide
  Target: SOD1; (+) strand; PAM type: YTN; PAM sequence: TTC
ataaatatgtactttatcaa

SEQ ID NO: 17262 - DNA, 20 bp, Artificial Sequence
  Description of Artificial Sequence: Synthetic oligonucleotide
  Target: SOD1; (+) strand; PAM type: YTN; PAM sequence: CTT
tatcaaatgtaggagagatc

SEQ ID NO: 17263 - DNA, 20 bp, Artificial Sequence
  Description of Artificial Sequence: Synthetic oligonucleotide
  Target: SOD1; (+) strand; PAM type: YTN; PAM sequence: TTT
atcaaatgtaggagagatca

SEQ ID NO: 17264 - DNA, 20 bp, Artificial Sequence
  Description of Artificial Sequence: Synthetic oligonucleotide
  Target: SOD1; (+) strand; PAM type: YTN; PAM sequence: TTA
tcaaatgtaggagagatcat

SEQ ID NO: 17265 - DNA, 20 bp, Artificial Sequence
  Description of Artificial Sequence: Synthetic oligonucleotide
  Target: SOD1; (+) strand; PAM type: YTN; PAM sequence: TTT
aggagaggaaaagctaaatt

SEQ ID NO: 17266 - DNA, 20 bp, Artificial Sequence
  Description of Artificial Sequence: Synthetic oligonucleotide
  Target: SOD1; (+) strand; PAM type: YTN; PAM sequence: TTA
ggagaggaaaagctaaattg

SEQ ID NO: 17267 - DNA, 20 bp, Artificial Sequence
  Description of Artificial Sequence: Synthetic oligonucleotide
  Target: SOD1; (+) strand; PAM type: YTN; PAM sequence: CTA
aattggaagacaaatctgta

SEQ ID NO: 17268 - DNA, 20 bp, Artificial Sequence
  Description of Artificial Sequence: Synthetic oligonucleotide
  Target: SOD1; (+) strand; PAM type: YTN; PAM sequence: TTG
gaagacaaatctgtagtgtt

SEQ ID NO: 17269 - DNA, 20 bp, Artificial Sequence
  Description of Artificial Sequence: Synthetic oligonucleotide
  Target: SOD1; (+) strand; PAM type: YTN; PAM sequence: CTG
tagtgtttccaaagttttaa

SEQ ID NO: 17270 - DNA, 20 bp, Artificial Sequence
  Description of Artificial Sequence: Synthetic oligonucleotide
  Target: SOD1; (+) strand; PAM type: YTN; PAM sequence: TTT
ccaaagttttaaaattatgg

SEQ ID NO: 17271 - DNA, 20 bp, Artificial Sequence
  Description of Artificial Sequence: Synthetic oligonucleotide
  Target: SOD1; (+) strand; PAM type: YTN; PAM sequence: TTC
caaagttttaaaattatggt

SEQ ID NO: 17272 - DNA, 20 bp, Artificial Sequence
  Description of Artificial Sequence: Synthetic oligonucleotide
  Target: SOD1; (+) strand; PAM type: YTN; PAM sequence: TTT
taaaattatggtaaacaaca

SEQ ID NO: 17273 - DNA, 20 bp, Artificial Sequence
  Description of Artificial Sequence: Synthetic oligonucleotide
  Target: SOD1; (+) strand; PAM type: YTN; PAM sequence: TTT
aaaattatggtaaacaacag

SEQ ID NO: 17274 - DNA, 20 bp, Artificial Sequence
  Description of Artificial Sequence: Synthetic oligonucleotide
  Target: SOD1; (+) strand; PAM type: YTN; PAM sequence: TTA
aaattatggtaaacaacagt

SEQ ID NO: 17275 - DNA, 20 bp, Artificial Sequence
  Description of Artificial Sequence: Synthetic oligonucleotide
  Target: SOD1; (+) strand; PAM type: YTN; PAM sequence: TTA
tggtaaacaacagtatgttc

SEQ ID NO: 17276 - DNA, 20 bp, Artificial Sequence
  Description of Artificial Sequence: Synthetic oligonucleotide
  Target: SOD1; (+) strand; PAM type: YTN; PAM sequence: TTC
acagtaagtggttaaaacaa

SEQ ID NO: 17277 - DNA, 20 bp, Artificial Sequence
  Description of Artificial Sequence: Synthetic oligonucleotide
  Target: SOD1; (+) strand; PAM type: YTN; PAM sequence: TTA
aaacaaccattctttaaatc

SEQ ID NO: 17278 - DNA, 20 bp, Artificial Sequence
  Description of Artificial Sequence: Synthetic oligonucleotide
  Target: SOD1; (+) strand; PAM type: YTN; PAM sequence: TTC
tttaaatctcagtagagaat

SEQ ID NO: 17279 - DNA, 20 bp, Artificial Sequence
  Description of Artificial Sequence: Synthetic oligonucleotide
  Target: SOD1; (+) strand; PAM type: YTN; PAM sequence: CTT
taaatctcagtagagaattt

SEQ ID NO: 17280 - DNA, 20 bp, Artificial Sequence
  Description of Artificial Sequence: Synthetic oligonucleotide
  Target: SOD1; (+) strand; PAM type: YTN; PAM sequence: TTT
aaatctcagtagagaatttt

SEQ ID NO: 17281 - DNA, 20 bp, Artificial Sequence
  Description of Artificial Sequence: Synthetic oligonucleotide
  Target: SOD1; (+) strand; PAM type: YTN; PAM sequence: TTA
aatctcagtagagaattttt

SEQ ID NO: 17282 - DNA, 20 bp, Artificial Sequence
  Description of Artificial Sequence: Synthetic oligonucleotide
  Target: SOD1; (+) strand; PAM type: YTN; PAM sequence: CTC
agtagagaatttttaaaaag

SEQ ID NO: 17283 - DNA, 20 bp, Artificial Sequence
  Description of Artificial Sequence: Synthetic oligonucleotide
  Target: SOD1; (+) strand; PAM type: YTN; PAM sequence: TTT
ttaaaaagcagtatttaaca

SEQ ID NO: 17284 - DNA, 20 bp, Artificial Sequence
  Description of Artificial Sequence: Synthetic oligonucleotide
  Target: SOD1; (+) strand; PAM type: YTN; PAM sequence: TTT
taaaaagcagtatttaacac

SEQ ID NO: 17285 - DNA, 20 bp, Artificial Sequence
  Description of Artificial Sequence: Synthetic oligonucleotide
  Target: SOD1; (+) strand; PAM type: YTN; PAM sequence: TTT
aaaaagcagtatttaacaca

SEQ ID NO: 17286 - DNA, 20 bp, Artificial Sequence
  Description of Artificial Sequence: Synthetic oligonucleotide
  Target: SOD1; (+) strand; PAM type: YTN; PAM sequence: TTA
aaaagcagtatttaacacat

SEQ ID NO: 17287 - DNA, 20 bp, Artificial Sequence
  Description of Artificial Sequence: Synthetic oligonucleotide
  Target: SOD1; (+) strand; PAM type: YTN; PAM sequence: TTT
aacacatttccctaatgtag

SEQ ID NO: 17288 - DNA, 20 bp, Artificial Sequence
  Description of Artificial Sequence: Synthetic oligonucleotide
  Target: SOD1; (+) strand; PAM type: YTN; PAM sequence: TTA
acacatttccctaatgtagt

SEQ ID NO: 17289 - DNA, 20 bp, Artificial Sequence
  Description of Artificial Sequence: Synthetic oligonucleotide
  Target: SOD1; (+) strand; PAM type: YTN; PAM sequence: TTT
ccctaatgtagtttgttgcc

SEQ ID NO: 17290 - DNA, 20 bp, Artificial Sequence
  Description of Artificial Sequence: Synthetic oligonucleotide
  Target: SOD1; (+) strand; PAM type: YTN; PAM sequence: TTC
cctaatgtagtttgttgcct

SEQ ID NO: 17291 - DNA, 20 bp, Artificial Sequence
  Description of Artificial Sequence: Synthetic oligonucleotide
  Target: SOD1; (+) strand; PAM type: YTN; PAM sequence: CTA
atgtagtttgttgcctatgt

SEQ ID NO: 17292 - DNA, 20 bp, Artificial Sequence
  Description of Artificial Sequence: Synthetic oligonucleotide
  Target: SOD1; (+) strand; PAM type: YTN; PAM sequence: TTT
gttgcctatgtggaataact

SEQ ID NO: 17293 - DNA, 20 bp, Artificial Sequence
  Description of Artificial Sequence: Synthetic oligonucleotide
  Target: SOD1; (+) strand; PAM type: YTN; PAM sequence: TTG
ttgcctatgtggaataactc

SEQ ID NO: 17294 - DNA, 20 bp, Artificial Sequence
  Description of Artificial Sequence: Synthetic oligonucleotide
  Target: SOD1; (+) strand; PAM type: YTN; PAM sequence: TTG
cctatgtggaataactcaat

SEQ ID NO: 17295 - DNA, 20 bp, Artificial Sequence
  Description of Artificial Sequence: Synthetic oligonucleotide
  Target: SOD1; (+) strand; PAM type: YTN; PAM sequence: CTA
tgtggaataactcaattaga

SEQ ID NO: 17296 - DNA, 20 bp, Artificial Sequence
  Description of Artificial Sequence: Synthetic oligonucleotide
  Target: SOD1; (+) strand; PAM type: YTN; PAM sequence: CTC
aattagagactcacttatgc

SEQ ID NO: 17297 - DNA, 20 bp, Artificial Sequence
  Description of Artificial Sequence: Synthetic oligonucleotide
  Target: SOD1; (+) strand; PAM type: YTN; PAM sequence: TTA
gagactcacttatgcctttt

SEQ ID NO: 17298 - DNA, 20 bp, Artificial Sequence
  Description of Artificial Sequence: Synthetic oligonucleotide
  Target: SOD1; (+) strand; PAM type: YTN; PAM sequence: CTC
acttatgccttttgaaactt

SEQ ID NO: 17299 - DNA, 20 bp, Artificial Sequence
  Description of Artificial Sequence: Synthetic oligonucleotide
  Target: SOD1; (+) strand; PAM type: YTN; PAM sequence: CTT
atgccttttgaaacttcaaa

SEQ ID NO: 17300 - DNA, 20 bp, Artificial Sequence
  Description of Artificial Sequence: Synthetic oligonucleotide
  Target: SOD1; (+) strand; PAM type: YTN; PAM sequence: TTA
tgccttttgaaacttcaaat

SEQ ID NO: 17301 - DNA, 20 bp, Artificial Sequence
  Description of Artificial Sequence: Synthetic oligonucleotide
  Target: SOD1; (+) strand; PAM type: YTN; PAM sequence: CTT
ttgaaacttcaaatataatt

SEQ ID NO: 17302 - DNA, 20 bp, Artificial Sequence
  Description of Artificial Sequence: Synthetic oligonucleotide
  Target: SOD1; (+) strand; PAM type: YTN; PAM sequence: TTT
tgaaacttcaaatataatta

SEQ ID NO: 17303 - DNA, 20 bp, Artificial Sequence
  Description of Artificial Sequence: Synthetic oligonucleotide
  Target: SOD1; (+) strand; PAM type: YTN; PAM sequence: TTT
gaaacttcaaatataattac

SEQ ID NO: 17304 - DNA, 20 bp, Artificial Sequence
  Description of Artificial Sequence: Synthetic oligonucleotide
  Target: SOD1; (+) strand; PAM type: YTN; PAM sequence: TTG
aaacttcaaatataattaca

SEQ ID NO: 17305 - DNA, 20 bp, Artificial Sequence
  Description of Artificial Sequence: Synthetic oligonucleotide
  Target: SOD1; (+) strand; PAM type: YTN; PAM sequence: CTT
caaatataattacactacca

SEQ ID NO: 17306 - DNA, 20 bp, Artificial Sequence
  Description of Artificial Sequence: Synthetic oligonucleotide
  Target: SOD1; (+) strand; PAM type: YTN; PAM sequence: TTC
aaatataattacactaccag

SEQ ID NO: 17307 - DNA, 20 bp, Artificial Sequence
  Description of Artificial Sequence: Synthetic oligonucleotide
  Target: SOD1; (+) strand; PAM type: YTN; PAM sequence: TTA
cactaccagtttttacatgt

SEQ ID NO: 17308 - DNA, 20 bp, Artificial Sequence
  Description of Artificial Sequence: Synthetic oligonucleotide
  Target: SOD1; (+) strand; PAM type: YTN; PAM sequence: CTA
ccagtttttacatgtgcata

SEQ ID NO: 17309 - DNA, 20 bp, Artificial Sequence
  Description of Artificial Sequence: Synthetic oligonucleotide
  Target: SOD1; (+) strand; PAM type: YTN; PAM sequence: TTT
ttacatgtgcatataggatg

SEQ ID NO: 17310 - DNA, 20 bp, Artificial Sequence
  Description of Artificial Sequence: Synthetic oligonucleotide
  Target: SOD1; (+) strand; PAM type: YTN; PAM sequence: TTT
tacatgtgcatataggatgg

SEQ ID NO: 17311 - DNA, 20 bp, Artificial Sequence
  Description of Artificial Sequence: Synthetic oligonucleotide
  Target: SOD1; (+) strand; PAM type: YTN; PAM sequence: TTT
acatgtgcatataggatggt

SEQ ID NO: 17312 - DNA, 20 bp, Artificial Sequence
  Description of Artificial Sequence: Synthetic oligonucleotide
  Target: SOD1; (+) strand; PAM type: YTN; PAM sequence: TTA
catgtgcatataggatggtc

SEQ ID NO: 17313 - DNA, 20 bp, Artificial Sequence
  Description of Artificial Sequence: Synthetic oligonucleotide
  Target: SOD1; (+) strand; PAM type: YTN; PAM sequence: CTT
taaattggaaatacaggctg

SEQ ID NO: 17314 - DNA, 20 bp, Artificial Sequence
  Description of Artificial Sequence: Synthetic oligonucleotide
  Target: SOD1; (+) strand; PAM type: YTN; PAM sequence: TTT
aaattggaaatacaggctgt

SEQ ID NO: 17315 - DNA, 20 bp, Artificial Sequence
  Description of Artificial Sequence: Synthetic oligonucleotide
  Target: SOD1; (+) strand; PAM type: YTN; PAM sequence: TTA
aattggaaatacaggctgta

SEQ ID NO: 17316 - DNA, 20 bp, Artificial Sequence
  Description of Artificial Sequence: Synthetic oligonucleotide
  Target: SOD1; (+) strand; PAM type: YTN; PAM sequence: TTG
gaaatacaggctgtaagtcc

SEQ ID NO: 17317 - DNA, 20 bp, Artificial Sequence
  Description of Artificial Sequence: Synthetic oligonucleotide
  Target: SOD1; (+) strand; PAM type: YTN; PAM sequence: CTG
taagtccttcaagtctggat

SEQ ID NO: 17318 - DNA, 20 bp, Artificial Sequence
  Description of Artificial Sequence: Synthetic oligonucleotide
  Target: SOD1; (+) strand; PAM type: YTN; PAM sequence: CTT
caagtctggatgttgggtaa

SEQ ID NO: 17319 - DNA, 20 bp, Artificial Sequence
  Description of Artificial Sequence: Synthetic oligonucleotide
  Target: SOD1; (+) strand; PAM type: YTN; PAM sequence: TTC
aagtctggatgttgggtaat

SEQ ID NO: 17320 - DNA, 20 bp, Artificial Sequence
  Description of Artificial Sequence: Synthetic oligonucleotide
  Target: SOD1; (+) strand; PAM type: YTN; PAM sequence: CTG
gatgttgggtaatcacgttt

SEQ ID NO: 17321 - DNA, 20 bp, Artificial Sequence
  Description of Artificial Sequence: Synthetic oligonucleotide
  Target: SOD1; (+) strand; PAM type: YTN; PAM sequence: TTG
ggtaatcacgttttcttcca

SEQ ID NO: 17322 - DNA, 20 bp, Artificial Sequence
  Description of Artificial Sequence: Synthetic oligonucleotide
  Target: SOD1; (+) strand; PAM type: YTN; PAM sequence: TTT
tcttccagaagccatttgtt

SEQ ID NO: 17323 - DNA, 20 bp, Artificial Sequence
  Description of Artificial Sequence: Synthetic oligonucleotide
  Target: SOD1; (+) strand; PAM type: YTN; PAM sequence: TTT
cttccagaagccatttgtta

SEQ ID NO: 17324 - DNA, 20 bp, Artificial Sequence
  Description of Artificial Sequence: Synthetic oligonucleotide
  Target: SOD1; (+) strand; PAM type: YTN; PAM sequence: TTC
ttccagaagccatttgttag

SEQ ID NO: 17325 - DNA, 20 bp, Artificial Sequence
  Description of Artificial Sequence: Synthetic oligonucleotide
  Target: SOD1; (+) strand; PAM type: YTN; PAM sequence: CTT
ccagaagccatttgttagga

SEQ ID NO: 17326 - DNA, 20 bp, Artificial Sequence
  Description of Artificial Sequence: Synthetic oligonucleotide
  Target: SOD1; (+) strand; PAM type: YTN; PAM sequence: TTC
cagaagccatttgttaggac

SEQ ID NO: 17327 - DNA, 20 bp, Artificial Sequence
  Description of Artificial Sequence: Synthetic oligonucleotide
  Target: SOD1; (+) strand; PAM type: YTN; PAM sequence: TTT
gttaggactttaaaacttct

SEQ ID NO: 17328 - DNA, 20 bp, Artificial Sequence
  Description of Artificial Sequence: Synthetic oligonucleotide
  Target: SOD1; (+) strand; PAM type: YTN; PAM sequence: TTG
ttaggactttaaaacttctc

SEQ ID NO: 17329 - DNA, 20 bp, Artificial Sequence
  Description of Artificial Sequence: Synthetic oligonucleotide
  Target: SOD1; (+) strand; PAM type: YTN; PAM sequence: TTA
ggactttaaaacttctcagt

SEQ ID NO: 17330 - DNA, 20 bp, Artificial Sequence
  Description of Artificial Sequence: Synthetic oligonucleotide
  Target: SOD1; (+) strand; PAM type: YTN; PAM sequence: CTT
taaaacttctcagtgggcca

SEQ ID NO: 17331 - DNA, 20 bp, Artificial Sequence
  Description of Artificial Sequence: Synthetic oligonucleotide
  Target: SOD1; (+) strand; PAM type: YTN; PAM sequence: TTT
aaaacttctcagtgggccag

SEQ ID NO: 17332 - DNA, 20 bp, Artificial Sequence
  Description of Artificial Sequence: Synthetic oligonucleotide
  Target: SOD1; (+) strand; PAM type: YTN; PAM sequence: TTA
aaacttctcagtgggccagt

SEQ ID NO: 17333 - DNA, 20 bp, Artificial Sequence
  Description of Artificial Sequence: Synthetic oligonucleotide
  Target: SOD1; (+) strand; PAM type: YTN; PAM sequence: CTT
ctcagtgggccagtgtaaaa

SEQ ID NO: 17334 - DNA, 20 bp, Artificial Sequence
  Description of Artificial Sequence: Synthetic oligonucleotide
  Target: SOD1; (+) strand; PAM type: YTN; PAM sequence: TTC
tcagtgggccagtgtaaaat

SEQ ID NO: 17335 - DNA, 20 bp, Artificial Sequence
  Description of Artificial Sequence: Synthetic oligonucleotide
  Target: SOD1; (+) strand; PAM type: YTN; PAM sequence: CTC
agtgggccagtgtaaaatta

SEQ ID NO: 17336 - DNA, 20 bp, Artificial Sequence
  Description of Artificial Sequence: Synthetic oligonucleotide
  Target: SOD1; (+) strand; PAM type: YTN; PAM sequence: TTA
aggacaagttttataattta

SEQ ID NO: 17337 - DNA, 20 bp, Artificial Sequence
  Description of Artificial Sequence: Synthetic oligonucleotide
  Target: SOD1; (+) strand; PAM type: YTN; PAM sequence: TTT
tataatttaaatttacagat

SEQ ID NO: 17338 - DNA, 20 bp, Artificial Sequence
  Description of Artificial Sequence: Synthetic oligonucleotide
  Target: SOD1; (+) strand; PAM type: YTN; PAM sequence: TTT
ataatttaaatttacagata

SEQ ID NO: 17339 - DNA, 20 bp, Artificial Sequence
  Description of Artificial Sequence: Synthetic oligonucleotide
  Target: SOD1; (+) strand; PAM type: YTN; PAM sequence: TTA
taatttaaatttacagataa

SEQ ID NO: 17340 - DNA, 20 bp, Artificial Sequence
  Description of Artificial Sequence: Synthetic oligonucleotide
  Target: SOD1; (+) strand; PAM type: YTN; PAM sequence: TTT
aaatttacagataaatataa

SEQ ID NO: 17341 - DNA, 20 bp, Artificial Sequence
  Description of Artificial Sequence: Synthetic oligonucleotide
  Target: SOD1; (+) strand; PAM type: YTN; PAM sequence: TTA
aatttacagataaatataaa

SEQ ID NO: 17342 - DNA, 20 bp, Artificial Sequence
  Description of Artificial Sequence: Synthetic oligonucleotide
  Target: SOD1; (+) strand; PAM type: YTN; PAM sequence: TTT
acagataaatataaaacaat

SEQ ID NO: 17343 - DNA, 20 bp, Artificial Sequence
  Description of Artificial Sequence: Synthetic oligonucleotide
  Target: SOD1; (+) strand; PAM type: YTN; PAM sequence: TTA
cagataaatataaaacaatt

SEQ ID NO: 17344 - DNA, 20 bp, Artificial Sequence
  Description of Artificial Sequence: Synthetic oligonucleotide
  Target: SOD1; (+) strand; PAM type: YTN; PAM sequence: TTT
tctctcattttctaaaggca

SEQ ID NO: 17345 - DNA, 20 bp, Artificial Sequence
  Description of Artificial Sequence: Synthetic oligonucleotide
  Target: SOD1; (+) strand; PAM type: YTN; PAM sequence: TTT
ctctcattttctaaaggcag

SEQ ID NO: 17346 - DNA, 20 bp, Artificial Sequence
  Description of Artificial Sequence: Synthetic oligonucleotide
  Target: SOD1; (+) strand; PAM type: YTN; PAM sequence: TTC
tctcattttctaaaggcagg

SEQ ID NO: 17347 - DNA, 20 bp, Artificial Sequence
  Description of Artificial Sequence: Synthetic oligonucleotide
  Target: SOD1; (+) strand; PAM type: YTN; PAM sequence: CTC
tcattttctaaaggcaggaa

SEQ ID NO: 17348 - DNA, 20 bp, Artificial Sequence
  Description of Artificial Sequence: Synthetic oligonucleotide
  Target: SOD1; (+) strand; PAM type: YTN; PAM sequence: CTC
attttctaaaggcaggaata

SEQ ID NO: 17349 - DNA, 20 bp, Artificial Sequence
  Description of Artificial Sequence: Synthetic oligonucleotide
  Target: SOD1; (+) strand; PAM type: YTN; PAM sequence: TTT
tctaaaggcaggaatataag

SEQ ID NO: 17350 - DNA, 20 bp, Artificial Sequence
  Description of Artificial Sequence: Synthetic oligonucleotide
  Target: SOD1; (+) strand; PAM type: YTN; PAM sequence: TTT
ctaaaggcaggaatataagg

SEQ ID NO: 17351 - DNA, 20 bp, Artificial Sequence
  Description of Artificial Sequence: Synthetic oligonucleotide
  Target: SOD1; (+) strand; PAM type: YTN; PAM sequence: TTC
taaaggcaggaatataagga

SEQ ID NO: 17352 - DNA, 20 bp, Artificial Sequence
  Description of Artificial Sequence: Synthetic oligonucleotide
  Target: SOD1; (+) strand; PAM type: YTN; PAM sequence: CTA
aaggcaggaatataaggaca

SEQ ID NO: 17353 - DNA, 20 bp, Artificial Sequence
  Description of Artificial Sequence: Synthetic oligonucleotide
  Target: SOD1; (+) strand; PAM type: YTN; PAM sequence: TTG
ccctagatatattctcccca

SEQ ID NO: 17354 - DNA, 20 bp, Artificial Sequence
  Description of Artificial Sequence: Synthetic oligonucleotide
  Target: SOD1; (+) strand; PAM type: YTN; PAM sequence: CTA
gatatattctccccatcaaa

SEQ ID NO: 17355 - DNA, 20 bp, Artificial Sequence
  Description of Artificial Sequence: Synthetic oligonucleotide
  Target: SOD1; (+) strand; PAM type: YTN; PAM sequence: TTC
tccccatcaaaccaaaggtc

SEQ ID NO: 17356 - DNA, 20 bp, Artificial Sequence
  Description of Artificial Sequence: Synthetic oligonucleotide
  Target: SOD1; (+) strand; PAM type: YTN; PAM sequence: CTC
cccatcaaaccaaaggtctt

SEQ ID NO: 17357 - DNA, 20 bp, Artificial Sequence
  Description of Artificial Sequence: Synthetic oligonucleotide
  Target: SOD1; (+) strand; PAM type: YTN; PAM sequence: CTT
gctgctgagtattatttaaa

SEQ ID NO: 17358 - DNA, 20 bp, Artificial Sequence
  Description of Artificial Sequence: Synthetic oligonucleotide
  Target: SOD1; (+) strand; PAM type: YTN; PAM sequence: TTG
ctgctgagtattatttaaaa

SEQ ID NO: 17359 - DNA, 20 bp, Artificial Sequence
  Description of Artificial Sequence: Synthetic oligonucleotide
  Target: SOD1; (+) strand; PAM type: YTN; PAM sequence: CTG
ctgagtattatttaaaaacc

SEQ ID NO: 17360 - DNA, 20 bp, Artificial Sequence
  Description of Artificial Sequence: Synthetic oligonucleotide
  Target: SOD1; (+) strand; PAM type: YTN; PAM sequence: CTG
agtattatttaaaaaccaga

SEQ ID NO: 17361 - DNA, 20 bp, Artificial Sequence
  Description of Artificial Sequence: Synthetic oligonucleotide
  Target: SOD1; (+) strand; PAM type: YTN; PAM sequence: TTA
tttaaaaaccagagtaataa

SEQ ID NO: 17362 - DNA, 20 bp, Artificial Sequence
  Description of Artificial Sequence: Synthetic oligonucleotide
  Target: SOD1; (+) strand; PAM type: YTN; PAM sequence: TTT
aaaaaccagagtaataaagc

SEQ ID NO: 17363 - DNA, 20 bp, Artificial Sequence
  Description of Artificial Sequence: Synthetic oligonucleotide
  Target: SOD1; (+) strand; PAM type: YTN; PAM sequence: TTA
aaaaccagagtaataaagca

SEQ ID NO: 17364 - DNA, 20 bp, Artificial Sequence
  Description of Artificial Sequence: Synthetic oligonucleotide
  Target: SOD1; (+) strand; PAM type: YTN; PAM sequence: CTT
cgcctgaggatgaaggcaaa

SEQ ID NO: 17365 - DNA, 20 bp, Artificial Sequence
  Description of Artificial Sequence: Synthetic oligonucleotide
  Target: SOD1; (+) strand; PAM type: YTN; PAM sequence: TTC
gcctgaggatgaaggcaaag

SEQ ID NO: 17366 - DNA, 20 bp, Artificial Sequence
  Description of Artificial Sequence: Synthetic oligonucleotide
  Target: SOD1; (+) strand; PAM type: YTN; PAM sequence: CTG
aggatgaaggcaaagacaaa

SEQ ID NO: 17367 - DNA, 20 bp, Artificial Sequence
  Description of Artificial Sequence: Synthetic oligonucleotide
  Target: SOD1; (+) strand; PAM type: YTN; PAM sequence: TTA
actgctcagcatactgaaac

SEQ ID NO: 17368 - DNA, 20 bp, Artificial Sequence
  Description of Artificial Sequence: Synthetic oligonucleotide
  Target: SOD1; (+) strand; PAM type: YTN; PAM sequence: CTG
ctcagcatactgaaaccagg

SEQ ID NO: 17369 - DNA, 20 bp, Artificial Sequence
  Description of Artificial Sequence: Synthetic oligonucleotide
  Target: SOD1; (+) strand; PAM type: YTN; PAM sequence: CTC
agcatactgaaaccaggagt

SEQ ID NO: 17370 - DNA, 20 bp, Artificial Sequence
  Description of Artificial Sequence: Synthetic oligonucleotide
  Target: SOD1; (+) strand; PAM type: YTN; PAM sequence: CTG
aaaccaggagtttgaaaaag

SEQ ID NO: 17371 - DNA, 20 bp, Artificial Sequence
  Description of Artificial Sequence: Synthetic oligonucleotide
  Target: SOD1; (+) strand; PAM type: YTN; PAM sequence: TTT
gaaaaagtaattcaaaacaa

SEQ ID NO: 17372 - DNA, 20 bp, Artificial Sequence
  Description of Artificial Sequence: Synthetic oligonucleotide
  Target: SOD1; (+) strand; PAM type: YTN; PAM sequence: TTG
aaaaagtaattcaaaacaac

SEQ ID NO: 17373 - DNA, 20 bp, Artificial Sequence
  Description of Artificial Sequence: Synthetic oligonucleotide
  Target: SOD1; (+) strand; PAM type: YTN; PAM sequence: TTC
aaaacaacttcaaggccata

SEQ ID NO: 17374 - DNA, 20 bp, Artificial Sequence
  Description of Artificial Sequence: Synthetic oligonucleotide
  Target: SOD1; (+) strand; PAM type: YTN; PAM sequence: CTT
caaggccataaatacttgga

SEQ ID NO: 17375 - DNA, 20 bp, Artificial Sequence
  Description of Artificial Sequence: Synthetic oligonucleotide
  Target: SOD1; (+) strand; PAM type: YTN; PAM sequence: TTC
aaggccataaatacttggat

SEQ ID NO: 17376 - DNA, 20 bp, Artificial Sequence
  Description of Artificial Sequence: Synthetic oligonucleotide
  Target: SOD1; (+) strand; PAM type: YTN; PAM sequence: CTT
ggatagtgtgacatcaggtc

SEQ ID NO: 17377 - DNA, 20 bp, Artificial Sequence
  Description of Artificial Sequence: Synthetic oligonucleotide
  Target: SOD1; (+) strand; PAM type: YTN; PAM sequence: TTG
gatagtgtgacatcaggtct

SEQ ID NO: 17378 - DNA, 20 bp, Artificial Sequence
  Description of Artificial Sequence: Synthetic oligonucleotide
  Target: SOD1; (+) strand; PAM type: YTN; PAM sequence: CTT
ggcactggatttcctgcaat

SEQ ID NO: 17379 - DNA, 20 bp, Artificial Sequence
  Description of Artificial Sequence: Synthetic oligonucleotide
  Target: SOD1; (+) strand; PAM type: YTN; PAM sequence: TTG
gcactggatttcctgcaatt

SEQ ID NO: 17380 - DNA, 20 bp, Artificial Sequence
  Description of Artificial Sequence: Synthetic oligonucleotide
  Target: SOD1; (+) strand; PAM type: YTN; PAM sequence: CTG
gatttcctgcaatttcagat

SEQ ID NO: 17381 - DNA, 20 bp, Artificial Sequence
  Description of Artificial Sequence: Synthetic oligonucleotide
  Target: SOD1; (+) strand; PAM type: YTN; PAM sequence: TTT
cctgcaatttcagatgaagg

SEQ ID NO: 17382 - DNA, 20 bp, Artificial Sequence
  Description of Artificial Sequence: Synthetic oligonucleotide
  Target: SOD1; (+) strand; PAM type: YTN; PAM sequence: TTC
ctgcaatttcagatgaaggc

SEQ ID NO: 17383 - DNA, 20 bp, Artificial Sequence
  Description of Artificial Sequence: Synthetic oligonucleotide
  Target: SOD1; (+) strand; PAM type: YTN; PAM sequence: CTG
caatttcagatgaaggcttg

SEQ ID NO: 17384 - DNA, 20 bp, Artificial Sequence
  Description of Artificial Sequence: Synthetic oligonucleotide
  Target: SOD1; (+) strand; PAM type: YTN; PAM sequence: TTT
cagatgaaggcttgacttgg

SEQ ID NO: 17385 - DNA, 20 bp, Artificial Sequence
  Description of Artificial Sequence: Synthetic oligonucleotide
  Target: SOD1; (+) strand; PAM type: YTN; PAM sequence: TTC
agatgaaggcttgacttggc

SEQ ID NO: 17386 - DNA, 20 bp, Artificial Sequence
  Description of Artificial Sequence: Synthetic oligonucleotide
  Target: SOD1; (+) strand; PAM type: YTN; PAM sequence: CTT
gacttggctttagatgtttt

SEQ ID NO: 17387 - DNA, 20 bp, Artificial Sequence
  Description of Artificial Sequence: Synthetic oligonucleotide
  Target: SOD1; (+) strand; PAM type: YTN; PAM sequence: TTG
acttggctttagatgttttc

SEQ ID NO: 17388 - DNA, 20 bp, Artificial Sequence
  Description of Artificial Sequence: Synthetic oligonucleotide
  Target: SOD1; (+) strand; PAM type: YTN; PAM sequence: CTT
ggctttagatgttttcatgt

SEQ ID NO: 17389 - DNA, 20 bp, Artificial Sequence
  Description of Artificial Sequence: Synthetic oligonucleotide
  Target: SOD1; (+) strand; PAM type: YTN; PAM sequence: TTG
gctttagatgttttcatgtg

SEQ ID NO: 17390 - DNA, 20 bp, Artificial Sequence
  Description of Artificial Sequence: Synthetic oligonucleotide
  Target: SOD1; (+) strand; PAM type: YTN; PAM sequence: CTT
tagatgttttcatgtgataa

SEQ ID NO: 17391 - DNA, 20 bp, Artificial Sequence
  Description of Artificial Sequence: Synthetic oligonucleotide
  Target: SOD1; (+) strand; PAM type: YTN; PAM sequence: TTT
agatgttttcatgtgataat

SEQ ID NO: 17392 - DNA, 20 bp, Artificial Sequence
  Description of Artificial Sequence: Synthetic oligonucleotide
  Target: SOD1; (+) strand; PAM type: YTN; PAM sequence: TTA
gatgttttcatgtgataatt

SEQ ID NO: 17393 - DNA, 20 bp, Artificial Sequence
  Description of Artificial Sequence: Synthetic oligonucleotide
  Target: SOD1; (+) strand; PAM type: YTN; PAM sequence: TTT
tcatgtgataattcttggat

SEQ ID NO: 17394 - DNA, 20 bp, Artificial Sequence
  Description of Artificial Sequence: Synthetic oligonucleotide
  Target: SOD1; (+) strand; PAM type: YTN; PAM sequence: TTT
catgtgataattcttggata

SEQ ID NO: 17395 - DNA, 20 bp, Artificial Sequence
  Description of Artificial Sequence: Synthetic oligonucleotide
  Target: SOD1; (+) strand; PAM type: YTN; PAM sequence: TTC
atgtgataattcttggataa

SEQ ID NO: 17396 - DNA, 20 bp, Artificial Sequence
  Description of Artificial Sequence: Synthetic oligonucleotide
  Target: SOD1; (+) strand; PAM type: YTN; PAM sequence: TTC
ttggataacctacaacgatt

SEQ ID NO: 17397 - DNA, 20 bp, Artificial Sequence
  Description of Artificial Sequence: Synthetic oligonucleotide
  Target: SOD1; (+) strand; PAM type: YTN; PAM sequence: CTT
ggataacctacaacgatttt

SEQ ID NO: 17398 - DNA, 20 bp, Artificial Sequence
  Description of Artificial Sequence: Synthetic oligonucleotide
  Target: SOD1; (+) strand; PAM type: YTN; PAM sequence: TTG
gataacctacaacgattttt

SEQ ID NO: 17399 - DNA, 20 bp, Artificial Sequence
  Description of Artificial Sequence: Synthetic oligonucleotide
  Target: SOD1; (+) strand; PAM type: YTN; PAM sequence: CTA
caacgatttttcctatttaa

SEQ ID NO: 17400 - DNA, 20 bp, Artificial Sequence
  Description of Artificial Sequence: Synthetic oligonucleotide
  Target: SOD1; (+) strand; PAM type: YTN; PAM sequence: TTT
ttcctatttaacccaccaac

SEQ ID NO: 17401 - DNA, 20 bp, Artificial Sequence
  Description of Artificial Sequence: Synthetic oligonucleotide
  Target: SOD1; (+) strand; PAM type: YTN; PAM sequence: TTT
tcctatttaacccaccaact

SEQ ID NO: 17402 - DNA, 20 bp, Artificial Sequence
  Description of Artificial Sequence: Synthetic oligonucleotide
  Target: SOD1; (+) strand; PAM type: YTN; PAM sequence: TTT
cctatttaacccaccaactt

SEQ ID NO: 17403 - DNA, 20 bp, Artificial Sequence
  Description of Artificial Sequence: Synthetic oligonucleotide
  Target: SOD1; (+) strand; PAM type: YTN; PAM sequence: TTC
ctatttaacccaccaacttt

SEQ ID NO: 17404 - DNA, 20 bp, Artificial Sequence
  Description of Artificial Sequence: Synthetic oligonucleotide
  Target: SOD1; (+) strand; PAM type: YTN; PAM sequence: CTA
tttaacccaccaactttaag

SEQ ID NO: 17405 - DNA, 20 bp, Artificial Sequence
  Description of Artificial Sequence: Synthetic oligonucleotide
  Target: SOD1; (+) strand; PAM type: YTN; PAM sequence: TTT
aacccaccaactttaagcaa

SEQ ID NO: 17406 - DNA, 20 bp, Artificial Sequence
  Description of Artificial Sequence: Synthetic oligonucleotide
  Target: SOD1; (+) strand; PAM type: YTN; PAM sequence: TTA
acccaccaactttaagcaaa

SEQ ID NO: 17407 - DNA, 20 bp, Artificial Sequence
  Description of Artificial Sequence: Synthetic oligonucleotide
  Target: SOD1; (+) strand; PAM type: YTN; PAM sequence: CTT
taagcaaaagaaagaacgta

SEQ ID NO: 17408 - DNA, 20 bp, Artificial Sequence
  Description of Artificial Sequence: Synthetic oligonucleotide
  Target: SOD1; (+) strand; PAM type: YTN; PAM sequence: TTT
aagcaaaagaaagaacgtat

SEQ ID NO: 17409 - DNA, 20 bp, Artificial Sequence
  Description of Artificial Sequence: Synthetic oligonucleotide
  Target: SOD1; (+) strand; PAM type: YTN; PAM sequence: TTA
agcaaaagaaagaacgtata

SEQ ID NO: 17410 - DNA, 20 bp, Artificial Sequence
  Description of Artificial Sequence: Synthetic oligonucleotide
  Target: SOD1; (+) strand; PAM type: YTN; PAM sequence: TTC
gtttacctctgccccgcagg

SEQ ID NO: 17411 - DNA, 20 bp, Artificial Sequence
  Description of Artificial Sequence: Synthetic oligonucleotide
  Target: SOD1; (+) strand; PAM type: YTN; PAM sequence: TTT
acctctgccccgcaggggaa

SEQ ID NO: 17412 - DNA, 20 bp, Artificial Sequence
  Description of Artificial Sequence: Synthetic oligonucleotide
  Target: SOD1; (+) strand; PAM type: YTN; PAM sequence: TTA
cctctgccccgcaggggaat

SEQ ID NO: 17413 - DNA, 20 bp, Artificial Sequence
  Description of Artificial Sequence: Synthetic oligonucleotide
  Target: SOD1; (+) strand; PAM type: YTN; PAM sequence: CTC
tgccccgcaggggaattaaa

SEQ ID NO: 17414 - DNA, 20 bp, Artificial Sequence
  Description of Artificial Sequence: Synthetic oligonucleotide
  Target: SOD1; (+) strand; PAM type: YTN; PAM sequence: CTG
ccccgcaggggaattaaaac

SEQ ID NO: 17415 - DNA, 20 bp, Artificial Sequence
  Description of Artificial Sequence: Synthetic oligonucleotide
  Target: SOD1; (+) strand; PAM type: YTN; PAM sequence: TTA
aaacgctggtgaagaaaggc

SEQ ID NO: 17416 - DNA, 20 bp, Artificial Sequence
  Description of Artificial Sequence: Synthetic oligonucleotide
  Target: SOD1; (+) strand; PAM type: YTN; PAM sequence: CTG
gtgaagaaaggcaacaggca

SEQ ID NO: 17417 - DNA, 20 bp, Artificial Sequence
  Description of Artificial Sequence: Synthetic oligonucleotide
  Target: SOD1; (+) strand; PAM type: YTN; PAM sequence: CTT
atataaggaaacagtagtag

SEQ ID NO: 17418 - DNA, 20 bp, Artificial Sequence
  Description of Artificial Sequence: Synthetic oligonucleotide
  Target: SOD1; (+) strand; PAM type: YTN; PAM sequence: TTA
tataaggaaacagtagtagg

SEQ ID NO: 17419 - DNA, 20 bp, Artificial Sequence
  Description of Artificial Sequence: Synthetic oligonucleotide
  Target: SOD1; (+) strand; PAM type: YTN; PAM sequence: CTG
cactgaagtcctcaaacaca

SEQ ID NO: 17420 - DNA, 20 bp, Artificial Sequence
  Description of Artificial Sequence: Synthetic oligonucleotide
  Target: SOD1; (+) strand; PAM type: YTN; PAM sequence: CTG
aagtcctcaaacacaacaaa

SEQ ID NO: 17421 - DNA, 20 bp, Artificial Sequence
  Description of Artificial Sequence: Synthetic oligonucleotide
  Target: SOD1; (+) strand; PAM type: YTN; PAM sequence: CTC
aaacacaacaaaaagctctt

SEQ ID NO: 17422 - DNA, 20 bp, Artificial Sequence
  Description of Artificial Sequence: Synthetic oligonucleotide
  Target: SOD1; (+) strand; PAM type: YTN; PAM sequence: CTC
ttaggttgcaaatgttaacc

SEQ ID NO: 17423 - DNA, 20 bp, Artificial Sequence
  Description of Artificial Sequence: Synthetic oligonucleotide
  Target: SOD1; (+) strand; PAM type: YTN; PAM sequence: CTT
aggttgcaaatgttaacctt

SEQ ID NO: 17424 - DNA, 20 bp, Artificial Sequence
  Description of Artificial Sequence: Synthetic oligonucleotide
  Target: SOD1; (+) strand; PAM type: YTN; PAM sequence: TTA
ggttgcaaatgttaaccttg

SEQ ID NO: 17425 - DNA, 20 bp, Artificial Sequence
  Description of Artificial Sequence: Synthetic oligonucleotide
  Target: SOD1; (+) strand; PAM type: YTN; PAM sequence: TTG
caaatgttaaccttgattct

SEQ ID NO: 17426 - DNA, 20 bp, Artificial Sequence
  Description of Artificial Sequence: Synthetic oligonucleotide
  Target: SOD1; (+) strand; PAM type: YTN; PAM sequence: TTA
accttgattcttttaccctt

SEQ ID NO: 17427 - DNA, 20 bp, Artificial Sequence
  Description of Artificial Sequence: Synthetic oligonucleotide
  Target: SOD1; (+) strand; PAM type: YTN; PAM sequence: CTT
gattcttttacccttttgaa

SEQ ID NO: 17428 - DNA, 20 bp, Artificial Sequence
  Description of Artificial Sequence: Synthetic oligonucleotide
  Target: SOD1; (+) strand; PAM type: YTN; PAM sequence: TTG
attcttttacccttttgaaa

SEQ ID NO: 17429 - DNA, 20 bp, Artificial Sequence
  Description of Artificial Sequence: Synthetic oligonucleotide
  Target: SOD1; (+) strand; PAM type: YTN; PAM sequence: TTC
ttttacccttttgaaaaatt

SEQ ID NO: 17430 - DNA, 20 bp, Artificial Sequence
  Description of Artificial Sequence: Synthetic oligonucleotide
  Target: SOD1; (+) strand; PAM type: YTN; PAM sequence: CTT
ttacccttttgaaaaattca

SEQ ID NO: 17431 - DNA, 20 bp, Artificial Sequence
  Description of Artificial Sequence: Synthetic oligonucleotide
  Target: SOD1; (+) strand; PAM type: YTN; PAM sequence: TTT
tacccttttgaaaaattcaa

SEQ ID NO: 17432 - DNA, 20 bp, Artificial Sequence
  Description of Artificial Sequence: Synthetic oligonucleotide
  Target: SOD1; (+) strand; PAM type: YTN; PAM sequence: TTT
acccttttgaaaaattcaat

SEQ ID NO: 17433 - DNA, 20 bp, Artificial Sequence
  Description of Artificial Sequence: Synthetic oligonucleotide
  Target: SOD1; (+) strand; PAM type: YTN; PAM sequence: TTA
cccttttgaaaaattcaatg

SEQ ID NO: 17434 - DNA, 20 bp, Artificial Sequence
  Description of Artificial Sequence: Synthetic oligonucleotide
  Target: SOD1; (+) strand; PAM type: YTN; PAM sequence: CTT
ttgaaaaattcaatgggatg

SEQ ID NO: 17435 - DNA, 20 bp, Artificial Sequence
  Description of Artificial Sequence: Synthetic oligonucleotide
  Target: SOD1; (+) strand; PAM type: YTN; PAM sequence: TTT
tgaaaaattcaatgggatgg

SEQ ID NO: 17436 - DNA, 20 bp, Artificial Sequence
  Description of Artificial Sequence: Synthetic oligonucleotide
  Target: SOD1; (+) strand; PAM type: YTN; PAM sequence: TTT
gaaaaattcaatgggatggt

SEQ ID NO: 17437 - DNA, 20 bp, Artificial Sequence
  Description of Artificial Sequence: Synthetic oligonucleotide
  Target: SOD1; (+) strand; PAM type: YTN; PAM sequence: TTG
aaaaattcaatgggatggtt

SEQ ID NO: 17438 - DNA, 20 bp, Artificial Sequence
  Description of Artificial Sequence: Synthetic oligonucleotide
  Target: SOD1; (+) strand; PAM type: YTN; PAM sequence: TTC
aatgggatggttggaaaaaa

SEQ ID NO: 17439 - DNA, 20 bp, Artificial Sequence
  Description of Artificial Sequence: Synthetic oligonucleotide
  Target: SOD1; (+) strand; PAM type: YTN; PAM sequence: TTG
gaaaaaaaaaaaaccacaga

SEQ ID NO: 17440 - DNA, 20 bp, Artificial Sequence
  Description of Artificial Sequence: Synthetic oligonucleotide
  Target: SOD1; (+) strand; PAM type: YTN; PAM sequence: CTT
ctaacgtaatacccaggcag

SEQ ID NO: 17441 - DNA, 20 bp, Artificial Sequence
  Description of Artificial Sequence: Synthetic oligonucleotide
  Target: SOD1; (+) strand; PAM type: YTN; PAM sequence: TTC
taacgtaatacccaggcagt

SEQ ID NO: 17442 - DNA, 20 bp, Artificial Sequence
  Description of Artificial Sequence: Synthetic oligonucleotide
  Target: SOD1; (+) strand; PAM type: YTN; PAM sequence: CTA
acgtaatacccaggcagtcc

SEQ ID NO: 17443 - DNA, 20 bp, Artificial Sequence
  Description of Artificial Sequence: Synthetic oligonucleotide
  Target: SOD1; (+) strand; PAM type: YTN; PAM sequence: TTT
atagtacaacgtgtaacact

SEQ ID NO: 17444 - DNA, 20 bp, Artificial Sequence
  Description of Artificial Sequence: Synthetic oligonucleotide
  Target: SOD1; (+) strand; PAM type: YTN; PAM sequence: TTA
tagtacaacgtgtaacactg

SEQ ID NO: 17445 - DNA, 20 bp, Artificial Sequence
  Description of Artificial Sequence: Synthetic oligonucleotide
  Target: SOD1; (+) strand; PAM type: YTN; PAM sequence: CTG
ggatccaacttttcacccag

SEQ ID NO: 17446 - DNA, 20 bp, Artificial Sequence
  Description of Artificial Sequence: Synthetic oligonucleotide
  Target: SOD1; (+) strand; PAM type: YTN; PAM sequence: CTT
ttcacccagcaaaatctcct

SEQ ID NO: 17447 - DNA, 20 bp, Artificial Sequence
  Description of Artificial Sequence: Synthetic oligonucleotide
  Target: SOD1; (+) strand; PAM type: YTN; PAM sequence: TTT
tcacccagcaaaatctcctt

SEQ ID NO: 17448 - DNA, 20 bp, Artificial Sequence
  Description of Artificial Sequence: Synthetic oligonucleotide
  Target: SOD1; (+) strand; PAM type: YTN; PAM sequence: TTT
cacccagcaaaatctcctta

SEQ ID NO: 17449 - DNA, 20 bp, Artificial Sequence
  Description of Artificial Sequence: Synthetic oligonucleotide
  Target: SOD1; (+) strand; PAM type: YTN; PAM sequence: TTC
acccagcaaaatctccttac

SEQ ID NO: 17450 - DNA, 20 bp, Artificial Sequence
  Description of Artificial Sequence: Synthetic oligonucleotide
  Target: SOD1; (+) strand; PAM type: YTN; PAM sequence: CTC
cttacaaattagggcaacat

SEQ ID NO: 17451 - DNA, 20 bp, Artificial Sequence
  Description of Artificial Sequence: Synthetic oligonucleotide
  Target: SOD1; (+) strand; PAM type: YTN; PAM sequence: CTT
acaaattagggcaacatata

SEQ ID NO: 17452 - DNA, 20 bp, Artificial Sequence
  Description of Artificial Sequence: Synthetic oligonucleotide
  Target: SOD1; (+) strand; PAM type: YTN; PAM sequence: TTA
caaattagggcaacatatac

SEQ ID NO: 17453 - DNA, 20 bp, Artificial Sequence
  Description of Artificial Sequence: Synthetic oligonucleotide
  Target: SOD1; (+) strand; PAM type: YTN; PAM sequence: TTA
gggcaacatataccacaaag

SEQ ID NO: 17454 - DNA, 20 bp, Artificial Sequence
  Description of Artificial Sequence: Synthetic oligonucleotide
  Target: SOD1; (+) strand; PAM type: YTN; PAM sequence: CTC
gattgaattgcaaacacagc

SEQ ID NO: 17455 - DNA, 20 bp, Artificial Sequence
  Description of Artificial Sequence: Synthetic oligonucleotide
  Target: SOD1; (+) strand; PAM type: YTN; PAM sequence: TTG
aattgcaaacacagcttttc

SEQ ID NO: 17456 - DNA, 20 bp, Artificial Sequence
  Description of Artificial Sequence: Synthetic oligonucleotide
  Target: SOD1; (+) strand; PAM type: YTN; PAM sequence: TTG
caaacacagcttttcaattg

SEQ ID NO: 17457 - DNA, 20 bp, Artificial Sequence
  Description of Artificial Sequence: Synthetic oligonucleotide
  Target: SOD1; (+) strand; PAM type: YTN; PAM sequence: CTT
ttcaattgacattaaaacaa

SEQ ID NO: 17458 - DNA, 20 bp, Artificial Sequence
  Description of Artificial Sequence: Synthetic oligonucleotide
  Target: SOD1; (+) strand; PAM type: YTN; PAM sequence: TTT
tcaattgacattaaaacaac

SEQ ID NO: 17459 - DNA, 20 bp, Artificial Sequence
  Description of Artificial Sequence: Synthetic oligonucleotide
  Target: SOD1; (+) strand; PAM type: YTN; PAM sequence: TTT
caattgacattaaaacaact

SEQ ID NO: 17460 - DNA, 20 bp, Artificial Sequence
  Description of Artificial Sequence: Synthetic oligonucleotide
  Target: SOD1; (+) strand; PAM type: YTN; PAM sequence: TTC
aattgacattaaaacaacta

SEQ ID NO: 17461 - DNA, 20 bp, Artificial Sequence
  Description of Artificial Sequence: Synthetic oligonucleotide
  Target: SOD1; (+) strand; PAM type: YTN; PAM sequence: TTG
acattaaaacaactaacctt

SEQ ID NO: 17462 - DNA, 20 bp, Artificial Sequence
  Description of Artificial Sequence: Synthetic oligonucleotide
  Target: SOD1; (+) strand; PAM type: YTN; PAM sequence: TTA
aaacaactaacctttacctt

SEQ ID NO: 17463 - DNA, 20 bp, Artificial Sequence
  Description of Artificial Sequence: Synthetic oligonucleotide
  Target: SOD1; (+) strand; PAM type: YTN; PAM sequence: CTA
acctttaccttatgactgag

SEQ ID NO: 17464 - DNA, 20 bp, Artificial Sequence
  Description of Artificial Sequence: Synthetic oligonucleotide
  Target: SOD1; (+) strand; PAM type: YTN; PAM sequence: CTT
taccttatgactgagcacta

SEQ ID NO: 17465 - DNA, 20 bp, Artificial Sequence
  Description of Artificial Sequence: Synthetic oligonucleotide
  Target: SOD1; (+) strand; PAM type: YTN; PAM sequence: TTT
accttatgactgagcactaa

SEQ ID NO: 17466 - DNA, 20 bp, Artificial Sequence
  Description of Artificial Sequence: Synthetic oligonucleotide
  Target: SOD1; (+) strand; PAM type: YTN; PAM sequence: TTA
ccttatgactgagcactaaa

SEQ ID NO: 17467 - DNA, 20 bp, Artificial Sequence
  Description of Artificial Sequence: Synthetic oligonucleotide
  Target: SOD1; (+) strand; PAM type: YTN; PAM sequence: CTT
atgactgagcactaaaaatc

SEQ ID NO: 17468 - DNA, 20 bp, Artificial Sequence
  Description of Artificial Sequence: Synthetic oligonucleotide
  Target: SOD1; (+) strand; PAM type: YTN; PAM sequence: TTA
tgactgagcactaaaaatca

SEQ ID NO: 17469 - DNA, 20 bp, Artificial Sequence
  Description of Artificial Sequence: Synthetic oligonucleotide
  Target: SOD1; (+) strand; PAM type: YTN; PAM sequence: CTG
agcactaaaaatcaaaagta

SEQ ID NO: 17470 - DNA, 20 bp, Artificial Sequence
  Description of Artificial Sequence: Synthetic oligonucleotide
  Target: SOD1; (+) strand; PAM type: YTN; PAM sequence: CTA
aaaatcaaaagtattacata

SEQ ID NO: 17471 - DNA, 20 bp, Artificial Sequence
  Description of Artificial Sequence: Synthetic oligonucleotide
  Target: SOD1; (+) strand; PAM type: YTN; PAM sequence: TTA
catatgaaagtgagaataac

SEQ ID NO: 17472 - DNA, 20 bp, Artificial Sequence
  Description of Artificial Sequence: Synthetic oligonucleotide
  Target: SOD1; (+) strand; PAM type: YTN; PAM sequence: CTA
cataaaatgtctattttcat

SEQ ID NO: 17473 - DNA, 20 bp, Artificial Sequence
  Description of Artificial Sequence: Synthetic oligonucleotide
  Target: SOD1; (+) strand; PAM type: YTN; PAM sequence: CTA
ttttcatcaaataagtctaa

SEQ ID NO: 17474 - DNA, 20 bp, Artificial Sequence
  Description of Artificial Sequence: Synthetic oligonucleotide
  Target: SOD1; (+) strand; PAM type: YTN; PAM sequence: TTT
tcatcaaataagtctaattt

SEQ ID NO: 17475 - DNA, 20 bp, Artificial Sequence
  Description of Artificial Sequence: Synthetic oligonucleotide
  Target: SOD1; (+) strand; PAM type: YTN; PAM sequence: TTT
catcaaataagtctaattta

SEQ ID NO: 17476 - DNA, 20 bp, Artificial Sequence
  Description of Artificial Sequence: Synthetic oligonucleotide
  Target: SOD1; (+) strand; PAM type: YTN; PAM sequence: TTC
atcaaataagtctaatttag

SEQ ID NO: 17477 - DNA, 20 bp, Artificial Sequence
  Description of Artificial Sequence: Synthetic oligonucleotide
  Target: SOD1; (+) strand; PAM type: YTN; PAM sequence: CTA
atttagactccaatacagta

SEQ ID NO: 17478 - DNA, 20 bp, Artificial Sequence
  Description of Artificial Sequence: Synthetic oligonucleotide
  Target: SOD1; (+) strand; PAM type: YTN; PAM sequence: TTT
agactccaatacagtattaa

SEQ ID NO: 17479 - DNA, 20 bp, Artificial Sequence
  Description of Artificial Sequence: Synthetic oligonucleotide
  Target: SOD1; (+) strand; PAM type: YTN; PAM sequence: TTA
gactccaatacagtattaac

SEQ ID NO: 17480 - DNA, 20 bp, Artificial Sequence
  Description of Artificial Sequence: Synthetic oligonucleotide
  Target: SOD1; (+) strand; PAM type: YTN; PAM sequence: CTC
caatacagtattaacagctc

SEQ ID NO: 17481 - DNA, 20 bp, Artificial Sequence
  Description of Artificial Sequence: Synthetic oligonucleotide
  Target: SOD1; (+) strand; PAM type: YTN; PAM sequence: TTA
acagctcaaactttgacggt

SEQ ID NO: 17482 - DNA, 20 bp, Artificial Sequence
  Description of Artificial Sequence: Synthetic oligonucleotide
  Target: SOD1; (+) strand; PAM type: YTN; PAM sequence: CTC
aaactttgacggtgaacaat

SEQ ID NO: 17483 - DNA, 20 bp, Artificial Sequence
  Description of Artificial Sequence: Synthetic oligonucleotide
  Target: SOD1; (+) strand; PAM type: YTN; PAM sequence: CTT
tgacggtgaacaatcctttt

SEQ ID NO: 17484 - DNA, 20 bp, Artificial Sequence
  Description of Artificial Sequence: Synthetic oligonucleotide
  Target: SOD1; (+) strand; PAM type: YTN; PAM sequence: TTT
gacggtgaacaatccttttc

SEQ ID NO: 17485 - DNA, 20 bp, Artificial Sequence
  Description of Artificial Sequence: Synthetic oligonucleotide
  Target: SOD1; (+) strand; PAM type: YTN; PAM sequence: TTG
acggtgaacaatccttttcc

SEQ ID NO: 17486 - DNA, 20 bp, Artificial Sequence
  Description of Artificial Sequence: Synthetic oligonucleotide
  Target: SOD1; (+) strand; PAM type: YTN; PAM sequence: CTT
ttccaccttaatgcagtgta

SEQ ID NO: 17487 - DNA, 20 bp, Artificial Sequence
  Description of Artificial Sequence: Synthetic oligonucleotide
  Target: SOD1; (+) strand; PAM type: YTN; PAM sequence: TTT
tccaccttaatgcagtgtag

SEQ ID NO: 17488 - DNA, 20 bp, Artificial Sequence
  Description of Artificial Sequence: Synthetic oligonucleotide
  Target: SOD1; (+) strand; PAM type: YTN; PAM sequence: TTT
ccaccttaatgcagtgtagg

SEQ ID NO: 17489 - DNA, 20 bp, Artificial Sequence
  Description of Artificial Sequence: Synthetic oligonucleotide
  Target: SOD1; (+) strand; PAM type: YTN; PAM sequence: TTC
caccttaatgcagtgtagga

SEQ ID NO: 17490 - DNA, 20 bp, Artificial Sequence
  Description of Artificial Sequence: Synthetic oligonucleotide
  Target: SOD1; (+) strand; PAM type: YTN; PAM sequence: CTT
aatgcagtgtaggaagaata

SEQ ID NO: 17491 - DNA, 20 bp, Artificial Sequence
  Description of Artificial Sequence: Synthetic oligonucleotide
  Target: SOD1; (+) strand; PAM type: YTN; PAM sequence: TTA
atgcagtgtaggaagaatag

SEQ ID NO: 17492 - DNA, 20 bp, Artificial Sequence
  Description of Artificial Sequence: Synthetic oligonucleotide
  Target: SOD1; (+) strand; PAM type: YTN; PAM sequence: TTA
aagtttgttacgaaaataga

SEQ ID NO: 17493 - DNA, 20 bp, Artificial Sequence
  Description of Artificial Sequence: Synthetic oligonucleotide
  Target: SOD1; (+) strand; PAM type: YTN; PAM sequence: TTT
gttacgaaaatagagtttat

SEQ ID NO: 17494 - DNA, 20 bp, Artificial Sequence
  Description of Artificial Sequence: Synthetic oligonucleotide
  Target: SOD1; (+) strand; PAM type: YTN; PAM sequence: TTG
ttacgaaaatagagtttatt

SEQ ID NO: 17495 - DNA, 20 bp, Artificial Sequence
  Description of Artificial Sequence: Synthetic oligonucleotide
  Target: SOD1; (+) strand; PAM type: YTN; PAM sequence: TTA
cgaaaatagagtttattaaa

SEQ ID NO: 17496 - DNA, 20 bp, Artificial Sequence
  Description of Artificial Sequence: Synthetic oligonucleotide
  Target: SOD1; (+) strand; PAM type: YTN; PAM sequence: TTT
attaaaaacatccctattgt

SEQ ID NO: 17497 - DNA, 20 bp, Artificial Sequence
  Description of Artificial Sequence: Synthetic oligonucleotide
  Target: SOD1; (+) strand; PAM type: YTN; PAM sequence: TTA
ttaaaaacatccctattgtt

SEQ ID NO: 17498 - DNA, 20 bp, Artificial Sequence
  Description of Artificial Sequence: Synthetic oligonucleotide
  Target: SOD1; (+) strand; PAM type: YTN; PAM sequence: TTA
aaaacatccctattgttttg

SEQ ID NO: 17499 - DNA, 20 bp, Artificial Sequence
  Description of Artificial Sequence: Synthetic oligonucleotide
  Target: SOD1; (+) strand; PAM type: YTN; PAM sequence: CTA
ttgttttgaggagctttcac

SEQ ID NO: 17500 - DNA, 20 bp, Artificial Sequence
  Description of Artificial Sequence: Synthetic oligonucleotide
  Target: SOD1; (+) strand; PAM type: YTN; PAM sequence: TTG
ttttgaggagctttcaccgt

SEQ ID NO: 17501 - DNA, 20 bp, Artificial Sequence
  Description of Artificial Sequence: Synthetic oligonucleotide
  Target: SOD1; (+) strand; PAM type: YTN; PAM sequence: TTT
tgaggagctttcaccgttac

SEQ ID NO: 17502 - DNA, 20 bp, Artificial Sequence
  Description of Artificial Sequence: Synthetic oligonucleotide
  Target: SOD1; (+) strand; PAM type: YTN; PAM sequence: TTT
gaggagctttcaccgttacc

SEQ ID NO: 17503 - DNA, 20 bp, Artificial Sequence
  Description of Artificial Sequence: Synthetic oligonucleotide
  Target: SOD1; (+) strand; PAM type: YTN; PAM sequence: TTG
aggagctttcaccgttacct

SEQ ID NO: 17504 - DNA, 20 bp, Artificial Sequence
  Description of Artificial Sequence: Synthetic oligonucleotide
  Target: SOD1; (+) strand; PAM type: YTN; PAM sequence: CTT
tcaccgttaccttgtcttaa

SEQ ID NO: 17505 - DNA, 20 bp, Artificial Sequence
  Description of Artificial Sequence: Synthetic oligonucleotide
  Target: SOD1; (+) strand; PAM type: YTN; PAM sequence: TTT
caccgttaccttgtcttaaa

SEQ ID NO: 17506 - DNA, 20 bp, Artificial Sequence
  Description of Artificial Sequence: Synthetic oligonucleotide
  Target: SOD1; (+) strand; PAM type: YTN; PAM sequence: TTC
accgttaccttgtcttaaat

SEQ ID NO: 17507 - DNA, 20 bp, Artificial Sequence
  Description of Artificial Sequence: Synthetic oligonucleotide
  Target: SOD1; (+) strand; PAM type: YTN; PAM sequence: TTA
ccttgtcttaaattaaaaaa

SEQ ID NO: 17508 - DNA, 20 bp, Artificial Sequence
  Description of Artificial Sequence: Synthetic oligonucleotide
  Target: SOD1; (+) strand; PAM type: YTN; PAM sequence: CTT
gtcttaaattaaaaaaaaaa

SEQ ID NO: 17509 - DNA, 20 bp, Artificial Sequence
  Description of Artificial Sequence: Synthetic oligonucleotide
  Target: SOD1; (+) strand; PAM type: YTN; PAM sequence: TTG
tcttaaattaaaaaaaaaaa

SEQ ID NO: 17510 - DNA, 20 bp, Artificial Sequence
  Description of Artificial Sequence: Synthetic oligonucleotide
  Target: SOD1; (+) strand; PAM type: YTN; PAM sequence: CTT
aaattaaaaaaaaaaaaaaa

SEQ ID NO: 17511 - DNA, 20 bp, Artificial Sequence
  Description of Artificial Sequence: Synthetic oligonucleotide
  Target: SOD1; (+) strand; PAM type: YTN; PAM sequence: TTA
aattaaaaaaaaaaaaaaaa

SEQ ID NO: 17512 - DNA, 20 bp, Artificial Sequence
  Description of Artificial Sequence: Synthetic oligonucleotide
  Target: SOD1; (+) strand; PAM type: YTN; PAM sequence: TTA
aaaaaaaaaaaaaaaataga

SEQ ID NO: 17513 - DNA, 20 bp, Artificial Sequence
  Description of Artificial Sequence: Synthetic oligonucleotide
  Target: SOD1; (+) strand; PAM type: YTN; PAM sequence: CTT
ctaattacgatttgtaaact

SEQ ID NO: 17514 - DNA, 20 bp, Artificial Sequence
  Description of Artificial Sequence: Synthetic oligonucleotide
  Target: SOD1; (+) strand; PAM type: YTN; PAM sequence: TTC
taattacgatttgtaaactt

SEQ ID NO: 17515 - DNA, 20 bp, Artificial Sequence
  Description of Artificial Sequence: Synthetic oligonucleotide
  Target: SOD1; (+) strand; PAM type: YTN; PAM sequence: CTA
attacgatttgtaaactttt

SEQ ID NO: 17516 - DNA, 20 bp, Artificial Sequence
  Description of Artificial Sequence: Synthetic oligonucleotide
  Target: SOD1; (+) strand; PAM type: YTN; PAM sequence: TTA
cgatttgtaaactttttaaa

SEQ ID NO: 17517 - DNA, 20 bp, Artificial Sequence
  Description of Artificial Sequence: Synthetic oligonucleotide
  Target: SOD1; (+) strand; PAM type: YTN; PAM sequence: TTT
gtaaactttttaaagtcaaa

SEQ ID NO: 17518 - DNA, 20 bp, Artificial Sequence
  Description of Artificial Sequence: Synthetic oligonucleotide
  Target: SOD1; (+) strand; PAM type: YTN; PAM sequence: TTG
taaactttttaaagtcaaaa

SEQ ID NO: 17519 - DNA, 20 bp, Artificial Sequence
  Description of Artificial Sequence: Synthetic oligonucleotide
  Target: SOD1; (+) strand; PAM type: YTN; PAM sequence: CTT
tttaaagtcaaaacttttaa

SEQ ID NO: 17520 - DNA, 20 bp, Artificial Sequence
  Description of Artificial Sequence: Synthetic oligonucleotide
  Target: SOD1; (+) strand; PAM type: YTN; PAM sequence: TTT
ttaaagtcaaaacttttaaa

SEQ ID NO: 17521 - DNA, 20 bp, Artificial Sequence
  Description of Artificial Sequence: Synthetic oligonucleotide
  Target: SOD1; (+) strand; PAM type: YTN; PAM sequence: TTT
taaagtcaaaacttttaaaa

SEQ ID NO: 17522 - DNA, 20 bp, Artificial Sequence
  Description of Artificial Sequence: Synthetic oligonucleotide
  Target: SOD1; (+) strand; PAM type: YTN; PAM sequence: TTT
aaagtcaaaacttttaaaaa

SEQ ID NO: 17523 - DNA, 20 bp, Artificial Sequence
  Description of Artificial Sequence: Synthetic oligonucleotide
  Target: SOD1; (+) strand; PAM type: YTN; PAM sequence: TTA
aagtcaaaacttttaaaaag

SEQ ID NO: 17524 - DNA, 20 bp, Artificial Sequence
  Description of Artificial Sequence: Synthetic oligonucleotide
  Target: SOD1; (+) strand; PAM type: YTN; PAM sequence: CTT
ttaaaaagttacagcaaaaa

SEQ ID NO: 17525 - DNA, 20 bp, Artificial Sequence
  Description of Artificial Sequence: Synthetic oligonucleotide
  Target: SOD1; (+) strand; PAM type: YTN; PAM sequence: TTT
taaaaagttacagcaaaaag

SEQ ID NO: 17526 - DNA, 20 bp, Artificial Sequence
  Description of Artificial Sequence: Synthetic oligonucleotide
  Target: SOD1; (+) strand; PAM type: YTN; PAM sequence: TTT
aaaaagttacagcaaaaagg

SEQ ID NO: 17527 - DNA, 20 bp, Artificial Sequence
  Description of Artificial Sequence: Synthetic oligonucleotide
  Target: SOD1; (+) strand; PAM type: YTN; PAM sequence: TTA
aaaagttacagcaaaaaggg

SEQ ID NO: 17528 - DNA, 20 bp, Artificial Sequence
  Description of Artificial Sequence: Synthetic oligonucleotide
  Target: SOD1; (+) strand; PAM type: YTN; PAM sequence: TTA
cagcaaaaagggtaatattt

SEQ ID NO: 17529 - DNA, 20 bp, Artificial Sequence
  Description of Artificial Sequence: Synthetic oligonucleotide
  Target: SOD1; (+) strand; PAM type: YTN; PAM sequence: TTT
attcatattttcagtatttt

SEQ ID NO: 17530 - DNA, 20 bp, Artificial Sequence
  Description of Artificial Sequence: Synthetic oligonucleotide
  Target: SOD1; (+) strand; PAM type: YTN; PAM sequence: TTA
ttcatattttcagtattttt

SEQ ID NO: 17531 - DNA, 20 bp, Artificial Sequence
  Description of Artificial Sequence: Synthetic oligonucleotide
  Target: SOD1; (+) strand; PAM type: YTN; PAM sequence: TTC
atattttcagtattttttgt

SEQ ID NO: 17532 - DNA, 20 bp, Artificial Sequence
  Description of Artificial Sequence: Synthetic oligonucleotide
  Target: SOD1; (+) strand; PAM type: YTN; PAM sequence: TTT
tcagtattttttgttatttt

SEQ ID NO: 17533 - DNA, 20 bp, Artificial Sequence
  Description of Artificial Sequence: Synthetic oligonucleotide
  Target: SOD1; (+) strand; PAM type: YTN; PAM sequence: TTT
cagtattttttgttattttg

SEQ ID NO: 17534 - DNA, 20 bp, Artificial Sequence
  Description of Artificial Sequence: Synthetic oligonucleotide
  Target: SOD1; (+) strand; PAM type: YTN; PAM sequence: TTC
agtattttttgttattttgt

SEQ ID NO: 17535 - DNA, 20 bp, Artificial Sequence
  Description of Artificial Sequence: Synthetic oligonucleotide
  Target: SOD1; (+) strand; PAM type: YTN; PAM sequence: TTT
tttgttattttgtggctatt

SEQ ID NO: 17536 - DNA, 20 bp, Artificial Sequence
  Description of Artificial Sequence: Synthetic oligonucleotide
  Target: SOD1; (+) strand; PAM type: YTN; PAM sequence: TTT
ttgttattttgtggctattt

SEQ ID NO: 17537 - DNA, 20 bp, Artificial Sequence
  Description of Artificial Sequence: Synthetic oligonucleotide
  Target: SOD1; (+) strand; PAM type: YTN; PAM sequence: TTT
tgttattttgtggctatttt

SEQ ID NO: 17538 - DNA, 20 bp, Artificial Sequence
  Description of Artificial Sequence: Synthetic oligonucleotide
  Target: SOD1; (+) strand; PAM type: YTN; PAM sequence: TTT
gttattttgtggctattttt

SEQ ID NO: 17539 - DNA, 20 bp, Artificial Sequence
  Description of Artificial Sequence: Synthetic oligonucleotide
  Target: SOD1; (+) strand; PAM type: YTN; PAM sequence: TTG
ttattttgtggctattttta

SEQ ID NO: 17540 - DNA, 20 bp, Artificial Sequence
  Description of Artificial Sequence: Synthetic oligonucleotide
  Target: SOD1; (+) strand; PAM type: YTN; PAM sequence: TTA
ttttgtggctatttttaaat

SEQ ID NO: 17541 - DNA, 20 bp, Artificial Sequence
  Description of Artificial Sequence: Synthetic oligonucleotide
  Target: SOD1; (+) strand; PAM type: YTN; PAM sequence: TTT
tgtggctatttttaaataga

SEQ ID NO: 17542 - DNA, 20 bp, Artificial Sequence
  Description of Artificial Sequence: Synthetic oligonucleotide
  Target: SOD1; (+) strand; PAM type: YTN; PAM sequence: TTT
gtggctatttttaaatagaa

SEQ ID NO: 17543 - DNA, 20 bp, Artificial Sequence
  Description of Artificial Sequence: Synthetic oligonucleotide
  Target: SOD1; (+) strand; PAM type: YTN; PAM sequence: TTG
tggctatttttaaatagaag

SEQ ID NO: 17544 - DNA, 20 bp, Artificial Sequence
  Description of Artificial Sequence: Synthetic oligonucleotide
  Target: SOD1; (+) strand; PAM type: YTN; PAM sequence: CTA
tttttaaatagaagggaagc

SEQ ID NO: 17545 - DNA, 20 bp, Artificial Sequence
  Description of Artificial Sequence: Synthetic oligonucleotide
  Target: SOD1; (+) strand; PAM type: YTN; PAM sequence: TTT
ttaaatagaagggaagcaat

SEQ ID NO: 17546 - DNA, 20 bp, Artificial Sequence
  Description of Artificial Sequence: Synthetic oligonucleotide
  Target: SOD1; (+) strand; PAM type: YTN; PAM sequence: TTT
taaatagaagggaagcaatc

SEQ ID NO: 17547 - DNA, 20 bp, Artificial Sequence
  Description of Artificial Sequence: Synthetic oligonucleotide
  Target: SOD1; (+) strand; PAM type: YTN; PAM sequence: TTT
aaatagaagggaagcaatca

SEQ ID NO: 17548 - DNA, 20 bp, Artificial Sequence
  Description of Artificial Sequence: Synthetic oligonucleotide
  Target: SOD1; (+) strand; PAM type: YTN; PAM sequence: TTA
aatagaagggaagcaatcaa

SEQ ID NO: 17549 - DNA, 20 bp, Artificial Sequence
  Description of Artificial Sequence: Synthetic oligonucleotide
  Target: SOD1; (+) strand; PAM type: YTN; PAM sequence: TTG
cttacagttccccaccagct

SEQ ID NO: 17550 - DNA, 20 bp, Artificial Sequence
  Description of Artificial Sequence: Synthetic oligonucleotide
  Target: SOD1; (+) strand; PAM type: YTN; PAM sequence: CTT
acagttccccaccagctggc

SEQ ID NO: 17551 - DNA, 20 bp, Artificial Sequence
  Description of Artificial Sequence: Synthetic oligonucleotide
  Target: SOD1; (+) strand; PAM type: YTN; PAM sequence: TTA
cagttccccaccagctggcg

SEQ ID NO: 17552 - DNA, 20 bp, Artificial Sequence
  Description of Artificial Sequence: Synthetic oligonucleotide
  Target: SOD1; (+) strand; PAM type: YTN; PAM sequence: TTC
cccaccagctggcgcggggc

SEQ ID NO: 17553 - DNA, 20 bp, Artificial Sequence
  Description of Artificial Sequence: Synthetic oligonucleotide
  Target: SOD1; (+) strand; PAM type: YTN; PAM sequence: CTG
gcgcggggctgcagtacagc

SEQ ID NO: 17554 - DNA, 20 bp, Artificial Sequence
  Description of Artificial Sequence: Synthetic oligonucleotide
  Target: SOD1; (+) strand; PAM type: YTN; PAM sequence: CTG
cagtacagcgggagcggata

SEQ ID NO: 17555 - DNA, 20 bp, Artificial Sequence
  Description of Artificial Sequence: Synthetic oligonucleotide
  Target: SOD1; (+) strand; PAM type: YTN; PAM sequence: CTG
tacacctcaagctctacact

SEQ ID NO: 17556 - DNA, 20 bp, Artificial Sequence
  Description of Artificial Sequence: Synthetic oligonucleotide
  Target: SOD1; (+) strand; PAM type: YTN; PAM sequence: CTC
aagctctacactccaggaag

SEQ ID NO: 17557 - DNA, 20 bp, Artificial Sequence
  Description of Artificial Sequence: Synthetic oligonucleotide
  Target: SOD1; (+) strand; PAM type: YTN; PAM sequence: CTC
tacactccaggaagtgtcac

SEQ ID NO: 17558 - DNA, 20 bp, Artificial Sequence
  Description of Artificial Sequence: Synthetic oligonucleotide
  Target: SOD1; (+) strand; PAM type: YTN; PAM sequence: CTA
cactccaggaagtgtcactg

SEQ ID NO: 17559 - DNA, 20 bp, Artificial Sequence
  Description of Artificial Sequence: Synthetic oligonucleotide
  Target: SOD1; (+) strand; PAM type: YTN; PAM sequence: CTC
caggaagtgtcactgtcaca

SEQ ID NO: 17560 - DNA, 20 bp, Artificial Sequence
  Description of Artificial Sequence: Synthetic oligonucleotide
  Target: SOD1; (+) strand; PAM type: YTN; PAM sequence: CTG
tcacattttcacaaattcca

SEQ ID NO: 17561 - DNA, 20 bp, Artificial Sequence
  Description of Artificial Sequence: Synthetic oligonucleotide
  Target: SOD1; (+) strand; PAM type: YTN; PAM sequence: TTT
tcacaaattccagtctctaa

SEQ ID NO: 17562 - DNA, 20 bp, Artificial Sequence
  Description of Artificial Sequence: Synthetic oligonucleotide
  Target: SOD1; (+) strand; PAM type: YTN; PAM sequence: TTT
cacaaattccagtctctaac

SEQ ID NO: 17563 - DNA, 20 bp, Artificial Sequence
  Description of Artificial Sequence: Synthetic oligonucleotide
  Target: SOD1; (+) strand; PAM type: YTN; PAM sequence: TTC
acaaattccagtctctaacg

SEQ ID NO: 17564 - DNA, 20 bp, Artificial Sequence
  Description of Artificial Sequence: Synthetic oligonucleotide
  Target: SOD1; (+) strand; PAM type: YTN; PAM sequence: TTC
cagtctctaacgaggagcct

SEQ ID NO: 17565 - DNA, 20 bp, Artificial Sequence
  Description of Artificial Sequence: Synthetic oligonucleotide
  Target: SOD1; (+) strand; PAM type: YTN; PAM sequence: CTC
taacgaggagcctctgctgc

SEQ ID NO: 17566 - DNA, 20 bp, Artificial Sequence
  Description of Artificial Sequence: Synthetic oligonucleotide
  Target: SOD1; (+) strand; PAM type: YTN; PAM sequence: CTA
acgaggagcctctgctgctg

SEQ ID NO: 17567 - DNA, 20 bp, Artificial Sequence
  Description of Artificial Sequence: Synthetic oligonucleotide
  Target: SOD1; (+) strand; PAM type: YTN; PAM sequence: CTC
tgctgctgagccagaatcct

SEQ ID NO: 17568 - DNA, 20 bp, Artificial Sequence
  Description of Artificial Sequence: Synthetic oligonucleotide
  Target: SOD1; (+) strand; PAM type: YTN; PAM sequence: CTG
ctgctgagccagaatccttt

SEQ ID NO: 17569 - DNA, 20 bp, Artificial Sequence
  Description of Artificial Sequence: Synthetic oligonucleotide
  Target: SOD1; (+) strand; PAM type: YTN; PAM sequence: CTG
ctgagccagaatccttttcg

SEQ ID NO: 17570 - DNA, 20 bp, Artificial Sequence
  Description of Artificial Sequence: Synthetic oligonucleotide
  Target: SOD1; (+) strand; PAM type: YTN; PAM sequence: CTG
agccagaatccttttcgggt

SEQ ID NO: 17571 - DNA, 20 bp, Artificial Sequence
  Description of Artificial Sequence: Synthetic oligonucleotide
  Target: SOD1; (+) strand; PAM type: YTN; PAM sequence: CTT
ttcgggttcaacggatgagg

SEQ ID NO: 17572 - DNA, 20 bp, Artificial Sequence
  Description of Artificial Sequence: Synthetic oligonucleotide
  Target: SOD1; (+) strand; PAM type: YTN; PAM sequence: TTT
tcgggttcaacggatgaggt

SEQ ID NO: 17573 - DNA, 20 bp, Artificial Sequence
  Description of Artificial Sequence: Synthetic oligonucleotide
  Target: SOD1; (+) strand; PAM type: YTN; PAM sequence: TTT
cgggttcaacggatgaggta

SEQ ID NO: 17574 - DNA, 20 bp, Artificial Sequence
  Description of Artificial Sequence: Synthetic oligonucleotide
  Target: SOD1; (+) strand; PAM type: YTN; PAM sequence: TTC
gggttcaacggatgaggtag

SEQ ID NO: 17575 - DNA, 20 bp, Artificial Sequence
  Description of Artificial Sequence: Synthetic oligonucleotide
  Target: SOD1; (+) strand; PAM type: YTN; PAM sequence: TTC
aacggatgaggtagcctcag

SEQ ID NO: 17576 - DNA, 20 bp, Artificial Sequence
  Description of Artificial Sequence: Synthetic oligonucleotide
  Target: SOD1; (+) strand; PAM type: YTN; PAM sequence: CTC
agcaggtaactcttcagaag

SEQ ID NO: 17577 - DNA, 20 bp, Artificial Sequence
  Description of Artificial Sequence: Synthetic oligonucleotide
  Target: SOD1; (+) strand; PAM type: YTN; PAM sequence: CTC
ttcagaaggctttaggactg

SEQ ID NO: 17578 - DNA, 20 bp, Artificial Sequence
  Description of Artificial Sequence: Synthetic oligonucleotide
  Target: SOD1; (+) strand; PAM type: YTN; PAM sequence: CTT
cagaaggctttaggactgca

SEQ ID NO: 17579 - DNA, 20 bp, Artificial Sequence
  Description of Artificial Sequence: Synthetic oligonucleotide
  Target: SOD1; (+) strand; PAM type: YTN; PAM sequence: TTC
agaaggctttaggactgcag

SEQ ID NO: 17580 - DNA, 20 bp, Artificial Sequence
  Description of Artificial Sequence: Synthetic oligonucleotide
  Target: SOD1; (+) strand; PAM type: YTN; PAM sequence: CTT
taggactgcagcctcagaca

SEQ ID NO: 17581 - DNA, 20 bp, Artificial Sequence
  Description of Artificial Sequence: Synthetic oligonucleotide
  Target: SOD1; (+) strand; PAM type: YTN; PAM sequence: TTT
aggactgcagcctcagacac

SEQ ID NO: 17582 - DNA, 20 bp, Artificial Sequence
  Description of Artificial Sequence: Synthetic oligonucleotide
  Target: SOD1; (+) strand; PAM type: YTN; PAM sequence: TTA
ggactgcagcctcagacacc

SEQ ID NO: 17583 - DNA, 20 bp, Artificial Sequence
  Description of Artificial Sequence: Synthetic oligonucleotide
  Target: SOD1; (+) strand; PAM type: YTN; PAM sequence: CTG
cagcctcagacacccccttc

SEQ ID NO: 17584 - DNA, 20 bp, Artificial Sequence
  Description of Artificial Sequence: Synthetic oligonucleotide
  Target: SOD1; (+) strand; PAM type: YTN; PAM sequence: CTC
agacacccccttctcaagtt

SEQ ID NO: 17585 - DNA, 20 bp, Artificial Sequence
  Description of Artificial Sequence: Synthetic oligonucleotide
  Target: SOD1; (+) strand; PAM type: YTN; PAM sequence: CTT
ctcaagttctgaagcagtgt

SEQ ID NO: 17586 - DNA, 20 bp, Artificial Sequence
  Description of Artificial Sequence: Synthetic oligonucleotide
  Target: SOD1; (+) strand; PAM type: YTN; PAM sequence: TTC
tcaagttctgaagcagtgtc

SEQ ID NO: 17587 - DNA, 20 bp, Artificial Sequence
  Description of Artificial Sequence: Synthetic oligonucleotide
  Target: SOD1; (+) strand; PAM type: YTN; PAM sequence: CTC
aagttctgaagcagtgtcta

SEQ ID NO: 17588 - DNA, 20 bp, Artificial Sequence
  Description of Artificial Sequence: Synthetic oligonucleotide
  Target: SOD1; (+) strand; PAM type: YTN; PAM sequence: TTC
tgaagcagtgtctacatttc

SEQ ID NO: 17589 - DNA, 20 bp, Artificial Sequence
  Description of Artificial Sequence: Synthetic oligonucleotide
  Target: SOD1; (+) strand; PAM type: YTN; PAM sequence: CTG
aagcagtgtctacatttccc

SEQ ID NO: 17590 - DNA, 20 bp, Artificial Sequence
  Description of Artificial Sequence: Synthetic oligonucleotide
  Target: SOD1; (+) strand; PAM type: YTN; PAM sequence: CTA
catttcccacttggctaatg

SEQ ID NO: 17591 - DNA, 20 bp, Artificial Sequence
  Description of Artificial Sequence: Synthetic oligonucleotide
  Target: SOD1; (+) strand; PAM type: YTN; PAM sequence: TTT
cccacttggctaatgggagg

SEQ ID NO: 17592 - DNA, 20 bp, Artificial Sequence
  Description of Artificial Sequence: Synthetic oligonucleotide
  Target: SOD1; (+) strand; PAM type: YTN; PAM sequence: TTC
ccacttggctaatgggaggt

SEQ ID NO: 17593 - DNA, 20 bp, Artificial Sequence
  Description of Artificial Sequence: Synthetic oligonucleotide
  Target: SOD1; (+) strand; PAM type: YTN; PAM sequence: CTT
ggctaatgggaggttcaacg

SEQ ID NO: 17594 - DNA, 20 bp, Artificial Sequence
  Description of Artificial Sequence: Synthetic oligonucleotide
  Target: SOD1; (+) strand; PAM type: YTN; PAM sequence: TTG
gctaatgggaggttcaacgg

SEQ ID NO: 17595 - DNA, 20 bp, Artificial Sequence
  Description of Artificial Sequence: Synthetic oligonucleotide
  Target: SOD1; (+) strand; PAM type: YTN; PAM sequence: CTA
atgggaggttcaacggtttt

SEQ ID NO: 17596 - DNA, 20 bp, Artificial Sequence
  Description of Artificial Sequence: Synthetic oligonucleotide
  Target: SOD1; (+) strand; PAM type: YTN; PAM sequence: TTC
aacggttttgttaccacctg

SEQ ID NO: 17597 - DNA, 20 bp, Artificial Sequence
  Description of Artificial Sequence: Synthetic oligonucleotide
  Target: SOD1; (+) strand; PAM type: YTN; PAM sequence: TTT
tgttaccacctgccctgtct

SEQ ID NO: 17598 - DNA, 20 bp, Artificial Sequence
  Description of Artificial Sequence: Synthetic oligonucleotide
  Target: SOD1; (+) strand; PAM type: YTN; PAM sequence: TTT
gttaccacctgccctgtctg

SEQ ID NO: 17599 - DNA, 20 bp, Artificial Sequence
  Description of Artificial Sequence: Synthetic oligonucleotide
  Target: SOD1; (+) strand; PAM type: YTN; PAM sequence: TTG
ttaccacctgccctgtctgt

SEQ ID NO: 17600 - DNA, 20 bp, Artificial Sequence
  Description of Artificial Sequence: Synthetic oligonucleotide
  Target: SOD1; (+) strand; PAM type: YTN; PAM sequence: TTA
ccacctgccctgtctgtcac

SEQ ID NO: 17601 - DNA, 20 bp, Artificial Sequence
  Description of Artificial Sequence: Synthetic oligonucleotide
  Target: SOD1; (+) strand; PAM type: YTN; PAM sequence: CTG
ccctgtctgtcacctcaggc

SEQ ID NO: 17602 - DNA, 20 bp, Artificial Sequence
  Description of Artificial Sequence: Synthetic oligonucleotide
  Target: SOD1; (+) strand; PAM type: YTN; PAM sequence: CTG
tctgtcacctcaggcttttc

SEQ ID NO: 17603 - DNA, 20 bp, Artificial Sequence
  Description of Artificial Sequence: Synthetic oligonucleotide
  Target: SOD1; (+) strand; PAM type: YTN; PAM sequence: CTG
tcacctcaggcttttccttt

SEQ ID NO: 17604 - DNA, 20 bp, Artificial Sequence
  Description of Artificial Sequence: Synthetic oligonucleotide
  Target: SOD1; (+) strand; PAM type: YTN; PAM sequence: CTC
aggcttttcctttcctcggg

SEQ ID NO: 17605 - DNA, 20 bp, Artificial Sequence
  Description of Artificial Sequence: Synthetic oligonucleotide
  Target: SOD1; (+) strand; PAM type: YTN; PAM sequence: CTT
ttcctttcctcgggcttctt

SEQ ID NO: 17606 - DNA, 20 bp, Artificial Sequence
  Description of Artificial Sequence: Synthetic oligonucleotide
  Target: SOD1; (+) strand; PAM type: YTN; PAM sequence: TTT
tcctttcctcgggcttcttc

SEQ ID NO: 17607 - DNA, 20 bp, Artificial Sequence
  Description of Artificial Sequence: Synthetic oligonucleotide
  Target: SOD1; (+) strand; PAM type: YTN; PAM sequence: TTT
cctttcctcgggcttcttcc

SEQ ID NO: 17608 - DNA, 20 bp, Artificial Sequence
  Description of Artificial Sequence: Synthetic oligonucleotide
  Target: SOD1; (+) strand; PAM type: YTN; PAM sequence: TTC
ctttcctcgggcttcttcct

SEQ ID NO: 17609 - DNA, 20 bp, Artificial Sequence
  Description of Artificial Sequence: Synthetic oligonucleotide
  Target: SOD1; (+) strand; PAM type: YTN; PAM sequence: CTT
tcctcgggcttcttccttct

SEQ ID NO: 17610 - DNA, 20 bp, Artificial Sequence
  Description of Artificial Sequence: Synthetic oligonucleotide
  Target: SOD1; (+) strand; PAM type: YTN; PAM sequence: TTT
cctcgggcttcttccttctc

SEQ ID NO: 17611 - DNA, 20 bp, Artificial Sequence
  Description of Artificial Sequence: Synthetic oligonucleotide
  Target: SOD1; (+) strand; PAM type: YTN; PAM sequence: TTC
ctcgggcttcttccttctct

SEQ ID NO: 17612 - DNA, 20 bp, Artificial Sequence
  Description of Artificial Sequence: Synthetic oligonucleotide
  Target: SOD1; (+) strand; PAM type: YTN; PAM sequence: CTC
gggcttcttccttctctcta

SEQ ID NO: 17613 - DNA, 20 bp, Artificial Sequence
  Description of Artificial Sequence: Synthetic oligonucleotide
  Target: SOD1; (+) strand; PAM type: YTN; PAM sequence: CTT
cttccttctctctacgagac

SEQ ID NO: 17614 - DNA, 20 bp, Artificial Sequence
  Description of Artificial Sequence: Synthetic oligonucleotide
  Target: SOD1; (+) strand; PAM type: YTN; PAM sequence: TTC
ttccttctctctacgagact

SEQ ID NO: 17615 - DNA, 20 bp, Artificial Sequence
  Description of Artificial Sequence: Synthetic oligonucleotide
  Target: SOD1; (+) strand; PAM type: YTN; PAM sequence: CTT
ccttctctctacgagactct

SEQ ID NO: 17616 - DNA, 20 bp, Artificial Sequence
  Description of Artificial Sequence: Synthetic oligonucleotide
  Target: SOD1; (+) strand; PAM type: YTN; PAM sequence: TTC
cttctctctacgagactctc

SEQ ID NO: 17617 - DNA, 20 bp, Artificial Sequence
  Description of Artificial Sequence: Synthetic oligonucleotide
  Target: SOD1; (+) strand; PAM type: YTN; PAM sequence: CTT
ctctctacgagactctctat

SEQ ID NO: 17618 - DNA, 20 bp, Artificial Sequence
  Description of Artificial Sequence: Synthetic oligonucleotide
  Target: SOD1; (+) strand; PAM type: YTN; PAM sequence: TTC
tctctacgagactctctatc

SEQ ID NO: 17619 - DNA, 20 bp, Artificial Sequence
  Description of Artificial Sequence: Synthetic oligonucleotide
  Target: SOD1; (+) strand; PAM type: YTN; PAM sequence: CTC
tctacgagactctctatctc

SEQ ID NO: 17620 - DNA, 20 bp, Artificial Sequence
  Description of Artificial Sequence: Synthetic oligonucleotide
  Target: SOD1; (+) strand; PAM type: YTN; PAM sequence: CTC
tacgagactctctatctcta

SEQ ID NO: 17621 - DNA, 20 bp, Artificial Sequence
  Description of Artificial Sequence: Synthetic oligonucleotide
  Target: SOD1; (+) strand; PAM type: YTN; PAM sequence: CTA
cgagactctctatctctaga

SEQ ID NO: 17622 - DNA, 20 bp, Artificial Sequence
  Description of Artificial Sequence: Synthetic oligonucleotide
  Target: SOD1; (+) strand; PAM type: YTN; PAM sequence: CTC
tctatctctagaatctctct

SEQ ID NO: 17623 - DNA, 20 bp, Artificial Sequence
  Description of Artificial Sequence: Synthetic oligonucleotide
  Target: SOD1; (+) strand; PAM type: YTN; PAM sequence: CTC
tatctctagaatctctctct

SEQ ID NO: 17624 - DNA, 20 bp, Artificial Sequence
  Description of Artificial Sequence: Synthetic oligonucleotide
  Target: SOD1; (+) strand; PAM type: YTN; PAM sequence: CTA
tctctagaatctctctctct

SEQ ID NO: 17625 - DNA, 20 bp, Artificial Sequence
  Description of Artificial Sequence: Synthetic oligonucleotide
  Target: SOD1; (+) strand; PAM type: YTN; PAM sequence: CTC
tagaatctctctctctgtct

SEQ ID NO: 17626 - DNA, 20 bp, Artificial Sequence
  Description of Artificial Sequence: Synthetic oligonucleotide
  Target: SOD1; (+) strand; PAM type: YTN; PAM sequence: CTA
gaatctctctctctgtctcg

SEQ ID NO: 17627 - DNA, 20 bp, Artificial Sequence
  Description of Artificial Sequence: Synthetic oligonucleotide
  Target: SOD1; (+) strand; PAM type: YTN; PAM sequence: CTC
tctctctgtctcgatgccca

SEQ ID NO: 17628 - DNA, 20 bp, Artificial Sequence
  Description of Artificial Sequence: Synthetic oligonucleotide
  Target: SOD1; (+) strand; PAM type: YTN; PAM sequence: CTC
tctctgtctcgatgcccact

SEQ ID NO: 17629 - DNA, 20 bp, Artificial Sequence
  Description of Artificial Sequence: Synthetic oligonucleotide
  Target: SOD1; (+) strand; PAM type: YTN; PAM sequence: CTC
tctgtctcgatgcccactag

SEQ ID NO: 17630 - DNA, 20 bp, Artificial Sequence
  Description of Artificial Sequence: Synthetic oligonucleotide
  Target: SOD1; (+) strand; PAM type: YTN; PAM sequence: CTC
tgtctcgatgcccactagag

SEQ ID NO: 17631 - DNA, 20 bp, Artificial Sequence
  Description of Artificial Sequence: Synthetic oligonucleotide
  Target: SOD1; (+) strand; PAM type: YTN; PAM sequence: CTG
tctcgatgcccactagagcg

SEQ ID NO: 17632 - DNA, 20 bp, Artificial Sequence
  Description of Artificial Sequence: Synthetic oligonucleotide
  Target: SOD1; (+) strand; PAM type: YTN; PAM sequence: CTC
gatgcccactagagcgtcta

SEQ ID NO: 17633 - DNA, 20 bp, Artificial Sequence
  Description of Artificial Sequence: Synthetic oligonucleotide
  Target: SOD1; (+) strand; PAM type: YTN; PAM sequence: CTA
gagcgtctatttctctcttc

SEQ ID NO: 17634 - DNA, 20 bp, Artificial Sequence
  Description of Artificial Sequence: Synthetic oligonucleotide
  Target: SOD1; (+) strand; PAM type: YTN; PAM sequence: CTA
tttctctcttccaagtctct

SEQ ID NO: 17635 - DNA, 20 bp, Artificial Sequence
  Description of Artificial Sequence: Synthetic oligonucleotide
  Target: SOD1; (+) strand; PAM type: YTN; PAM sequence: TTT
ctctcttccaagtctctgtg

SEQ ID NO: 17636 - DNA, 20 bp, Artificial Sequence
  Description of Artificial Sequence: Synthetic oligonucleotide
  Target: SOD1; (+) strand; PAM type: YTN; PAM sequence: TTC
tctcttccaagtctctgtgc

SEQ ID NO: 17637 - DNA, 20 bp, Artificial Sequence
  Description of Artificial Sequence: Synthetic oligonucleotide
  Target: SOD1; (+) strand; PAM type: YTN; PAM sequence: CTC
tcttccaagtctctgtgcct

SEQ ID NO: 17638 - DNA, 20 bp, Artificial Sequence
  Description of Artificial Sequence: Synthetic oligonucleotide
  Target: SOD1; (+) strand; PAM type: YTN; PAM sequence: CTC
ttccaagtctctgtgcctgt

SEQ ID NO: 17639 - DNA, 20 bp, Artificial Sequence
  Description of Artificial Sequence: Synthetic oligonucleotide
  Target: SOD1; (+) strand; PAM type: YTN; PAM sequence: CTT
ccaagtctctgtgcctgtcc

SEQ ID NO: 17640 - DNA, 20 bp, Artificial Sequence
  Description of Artificial Sequence: Synthetic oligonucleotide
  Target: SOD1; (+) strand; PAM type: YTN; PAM sequence: TTC
caagtctctgtgcctgtccc

SEQ ID NO: 17641 - DNA, 20 bp, Artificial Sequence
  Description of Artificial Sequence: Synthetic oligonucleotide
  Target: SOD1; (+) strand; PAM type: YTN; PAM sequence: CTC
tgtgcctgtcccggtcaggg

SEQ ID NO: 17642 - DNA, 20 bp, Artificial Sequence
  Description of Artificial Sequence: Synthetic oligonucleotide
  Target: SOD1; (+) strand; PAM type: YTN; PAM sequence: CTG
tgcctgtcccggtcagggct

SEQ ID NO: 17643 - DNA, 20 bp, Artificial Sequence
  Description of Artificial Sequence: Synthetic oligonucleotide
  Target: SOD1; (+) strand; PAM type: YTN; PAM sequence: CTG
tcccggtcagggctcctcct

SEQ ID NO: 17644 - DNA, 20 bp, Artificial Sequence
  Description of Artificial Sequence: Synthetic oligonucleotide
  Target: SOD1; (+) strand; PAM type: YTN; PAM sequence: CTC
ctccttccccactctctcct

SEQ ID NO: 17645 - DNA, 20 bp, Artificial Sequence
  Description of Artificial Sequence: Synthetic oligonucleotide
  Target: SOD1; (+) strand; PAM type: YTN; PAM sequence: CTC
cttccccactctctcctgtc

SEQ ID NO: 17646 - DNA, 20 bp, Artificial Sequence
  Description of Artificial Sequence: Synthetic oligonucleotide
  Target: SOD1; (+) strand; PAM type: YTN; PAM sequence: CTT
ccccactctctcctgtcacg

SEQ ID NO: 17647 - DNA, 20 bp, Artificial Sequence
  Description of Artificial Sequence: Synthetic oligonucleotide
  Target: SOD1; (+) strand; PAM type: YTN; PAM sequence: TTC
cccactctctcctgtcacgg

SEQ ID NO: 17648 - DNA, 20 bp, Artificial Sequence
  Description of Artificial Sequence: Synthetic oligonucleotide
  Target: SOD1; (+) strand; PAM type: YTN; PAM sequence: CTC
tctcctgtcacggttactat

SEQ ID NO: 17649 - DNA, 20 bp, Artificial Sequence
  Description of Artificial Sequence: Synthetic oligonucleotide
  Target: SOD1; (+) strand; PAM type: YTN; PAM sequence: CTC
tcctgtcacggttactatta

SEQ ID NO: 17650 - DNA, 20 bp, Artificial Sequence
  Description of Artificial Sequence: Synthetic oligonucleotide
  Target: SOD1; (+) strand; PAM type: YTN; PAM sequence: CTC
ctgtcacggttactattatc

SEQ ID NO: 17651 - DNA, 20 bp, Artificial Sequence
  Description of Artificial Sequence: Synthetic oligonucleotide
  Target: SOD1; (+) strand; PAM type: YTN; PAM sequence: CTG
tcacggttactattatctct

SEQ ID NO: 17652 - DNA, 20 bp, Artificial Sequence
  Description of Artificial Sequence: Synthetic oligonucleotide
  Target: SOD1; (+) strand; PAM type: YTN; PAM sequence: TTA
ctattatctctatcatcatt

SEQ ID NO: 17653 - DNA, 20 bp, Artificial Sequence
  Description of Artificial Sequence: Synthetic oligonucleotide
  Target: SOD1; (+) strand; PAM type: YTN; PAM sequence: CTA
ttatctctatcatcattacg

SEQ ID NO: 17654 - DNA, 20 bp, Artificial Sequence
  Description of Artificial Sequence: Synthetic oligonucleotide
  Target: SOD1; (+) strand; PAM type: YTN; PAM sequence: TTA
tctctatcatcattacggtt

SEQ ID NO: 17655 - DNA, 20 bp, Artificial Sequence
  Description of Artificial Sequence: Synthetic oligonucleotide
  Target: SOD1; (+) strand; PAM type: YTN; PAM sequence: CTC
tatcatcattacggttccca

SEQ ID NO: 17656 - DNA, 20 bp, Artificial Sequence
  Description of Artificial Sequence: Synthetic oligonucleotide
  Target: SOD1; (+) strand; PAM type: YTN; PAM sequence: CTA
tcatcattacggttcccata

SEQ ID NO: 17657 - DNA, 20 bp, Artificial Sequence
  Description of Artificial Sequence: Synthetic oligonucleotide
  Target: SOD1; (+) strand; PAM type: YTN; PAM sequence: TTA
cggttcccataccgttcccg

SEQ ID NO: 17658 - DNA, 20 bp, Artificial Sequence
  Description of Artificial Sequence: Synthetic oligonucleotide
  Target: SOD1; (+) strand; PAM type: YTN; PAM sequence: TTC
ccataccgttcccggtcatt

SEQ ID NO: 17659 - DNA, 20 bp, Artificial Sequence
  Description of Artificial Sequence: Synthetic oligonucleotide
  Target: SOD1; (+) strand; PAM type: YTN; PAM sequence: TTC
ccggtcattttccaccctat

SEQ ID NO: 17660 - DNA, 20 bp, Artificial Sequence
  Description of Artificial Sequence: Synthetic oligonucleotide
  Target: SOD1; (+) strand; PAM type: YTN; PAM sequence: TTT
tccaccctatttccaaaaga

SEQ ID NO: 17661 - DNA, 20 bp, Artificial Sequence
  Description of Artificial Sequence: Synthetic oligonucleotide
  Target: SOD1; (+) strand; PAM type: YTN; PAM sequence: TTT
ccaccctatttccaaaagat

SEQ ID NO: 17662 - DNA, 20 bp, Artificial Sequence
  Description of Artificial Sequence: Synthetic oligonucleotide
  Target: SOD1; (+) strand; PAM type: YTN; PAM sequence: TTC
caccctatttccaaaagatc

SEQ ID NO: 17663 - DNA, 20 bp, Artificial Sequence
  Description of Artificial Sequence: Synthetic oligonucleotide
  Target: SOD1; (+) strand; PAM type: YTN; PAM sequence: CTA
tttccaaaagatcttcttcc

SEQ ID NO: 17664 - DNA, 20 bp, Artificial Sequence
  Description of Artificial Sequence: Synthetic oligonucleotide
  Target: SOD1; (+) strand; PAM type: YTN; PAM sequence: TTT
ccaaaagatcttcttccaaa

SEQ ID NO: 17665 - DNA, 20 bp, Artificial Sequence
  Description of Artificial Sequence: Synthetic oligonucleotide
  Target: SOD1; (+) strand; PAM type: YTN; PAM sequence: TTC
caaaagatcttcttccaaac

SEQ ID NO: 17666 - DNA, 20 bp, Artificial Sequence
  Description of Artificial Sequence: Synthetic oligonucleotide
  Target: SOD1; (+) strand; PAM type: YTN; PAM sequence: CTT
cttccaaacctttcttggtc

SEQ ID NO: 17667 - DNA, 20 bp, Artificial Sequence
  Description of Artificial Sequence: Synthetic oligonucleotide
  Target: SOD1; (+) strand; PAM type: YTN; PAM sequence: TTC
ttccaaacctttcttggtct

SEQ ID NO: 17668 - DNA, 20 bp, Artificial Sequence
  Description of Artificial Sequence: Synthetic oligonucleotide
  Target: SOD1; (+) strand; PAM type: YTN; PAM sequence: CTT
ccaaacctttcttggtctct

SEQ ID NO: 17669 - DNA, 20 bp, Artificial Sequence
  Description of Artificial Sequence: Synthetic oligonucleotide
  Target: SOD1; (+) strand; PAM type: YTN; PAM sequence: TTC
caaacctttcttggtctcta

SEQ ID NO: 17670 - DNA, 20 bp, Artificial Sequence
  Description of Artificial Sequence: Synthetic oligonucleotide
  Target: SOD1; (+) strand; PAM type: YTN; PAM sequence: CTT
tcttggtctctacctgaatt

SEQ ID NO: 17671 - DNA, 20 bp, Artificial Sequence
  Description of Artificial Sequence: Synthetic oligonucleotide
  Target: SOD1; (+) strand; PAM type: YTN; PAM sequence: TTT
cttggtctctacctgaattg

SEQ ID NO: 17672 - DNA, 20 bp, Artificial Sequence
  Description of Artificial Sequence: Synthetic oligonucleotide
  Target: SOD1; (+) strand; PAM type: YTN; PAM sequence: TTC
ttggtctctacctgaattga

SEQ ID NO: 17673 - DNA, 20 bp, Artificial Sequence
  Description of Artificial Sequence: Synthetic oligonucleotide
  Target: SOD1; (+) strand; PAM type: YTN; PAM sequence: CTT
ggtctctacctgaattgaac

SEQ ID NO: 17674 - DNA, 20 bp, Artificial Sequence
  Description of Artificial Sequence: Synthetic oligonucleotide
  Target: SOD1; (+) strand; PAM type: YTN; PAM sequence: TTG
gtctctacctgaattgaact

SEQ ID NO: 17675 - DNA, 20 bp, Artificial Sequence
  Description of Artificial Sequence: Synthetic oligonucleotide
  Target: SOD1; (+) strand; PAM type: YTN; PAM sequence: CTC
tacctgaattgaactgctgc

SEQ ID NO: 17676 - DNA, 20 bp, Artificial Sequence
  Description of Artificial Sequence: Synthetic oligonucleotide
  Target: SOD1; (+) strand; PAM type: YTN; PAM sequence: CTA
cctgaattgaactgctgcct

SEQ ID NO: 17677 - DNA, 20 bp, Artificial Sequence
  Description of Artificial Sequence: Synthetic oligonucleotide
  Target: SOD1; (+) strand; PAM type: YTN; PAM sequence: CTG
aattgaactgctgcctgtta

SEQ ID NO: 17678 - DNA, 20 bp, Artificial Sequence
  Description of Artificial Sequence: Synthetic oligonucleotide
  Target: SOD1; (+) strand; PAM type: YTN; PAM sequence: TTG
aactgctgcctgttatcatt

SEQ ID NO: 17679 - DNA, 20 bp, Artificial Sequence
  Description of Artificial Sequence: Synthetic oligonucleotide
  Target: SOD1; (+) strand; PAM type: YTN; PAM sequence: CTG
ctgcctgttatcatttctaa

SEQ ID NO: 17680 - DNA, 20 bp, Artificial Sequence
  Description of Artificial Sequence: Synthetic oligonucleotide
  Target: SOD1; (+) strand; PAM type: YTN; PAM sequence: CTG
cctgttatcatttctaaact

SEQ ID NO: 17681 - DNA, 20 bp, Artificial Sequence
  Description of Artificial Sequence: Synthetic oligonucleotide
  Target: SOD1; (+) strand; PAM type: YTN; PAM sequence: CTG
ttatcatttctaaactgctg

SEQ ID NO: 17682 - DNA, 20 bp, Artificial Sequence
  Description of Artificial Sequence: Synthetic oligonucleotide
  Target: SOD1; (+) strand; PAM type: YTN; PAM sequence: TTA
tcatttctaaactgctgtgg

SEQ ID NO: 17683 - DNA, 20 bp, Artificial Sequence
  Description of Artificial Sequence: Synthetic oligonucleotide
  Target: SOD1; (+) strand; PAM type: YTN; PAM sequence: TTT
ctaaactgctgtggctgctg

SEQ ID NO: 17684 - DNA, 20 bp, Artificial Sequence
  Description of Artificial Sequence: Synthetic oligonucleotide
  Target: SOD1; (+) strand; PAM type: YTN; PAM sequence: TTC
taaactgctgtggctgctgc

SEQ ID NO: 17685 - DNA, 20 bp, Artificial Sequence
  Description of Artificial Sequence: Synthetic oligonucleotide
  Target: SOD1; (+) strand; PAM type: YTN; PAM sequence: CTA
aactgctgtggctgctgctg

SEQ ID NO: 17686 - DNA, 20 bp, Artificial Sequence
  Description of Artificial Sequence: Synthetic oligonucleotide
  Target: SOD1; (+) strand; PAM type: YTN; PAM sequence: CTG
ctgtggctgctgctgtgttg

SEQ ID NO: 17687 - DNA, 20 bp, Artificial Sequence
  Description of Artificial Sequence: Synthetic oligonucleotide
  Target: SOD1; (+) strand; PAM type: YTN; PAM sequence: CTG
tggctgctgctgtgttggtg

SEQ ID NO: 17688 - DNA, 20 bp, Artificial Sequence
  Description of Artificial Sequence: Synthetic oligonucleotide
  Target: SOD1; (+) strand; PAM type: YTN; PAM sequence: CTG
ctgctgtgttggtggaggct

SEQ ID NO: 17689 - DNA, 20 bp, Artificial Sequence
  Description of Artificial Sequence: Synthetic oligonucleotide
  Target: SOD1; (+) strand; PAM type: YTN; PAM sequence: CTG
ctgtgttggtggaggctgtt

SEQ ID NO: 17690 - DNA, 20 bp, Artificial Sequence
  Description of Artificial Sequence: Synthetic oligonucleotide
  Target: SOD1; (+) strand; PAM type: YTN; PAM sequence: CTG
tgttggtggaggctgttgtg

SEQ ID NO: 17691 - DNA, 20 bp, Artificial Sequence
  Description of Artificial Sequence: Synthetic oligonucleotide
  Target: SOD1; (+) strand; PAM type: YTN; PAM sequence: TTG
gtggaggctgttgtgatggt

SEQ ID NO: 17692 - DNA, 20 bp, Artificial Sequence
  Description of Artificial Sequence: Synthetic oligonucleotide
  Target: SOD1; (+) strand; PAM type: YTN; PAM sequence: CTG
ttgtgatggtggtggctgct

SEQ ID NO: 17693 - DNA, 20 bp, Artificial Sequence
  Description of Artificial Sequence: Synthetic oligonucleotide
  Target: SOD1; (+) strand; PAM type: YTN; PAM sequence: TTG
tgatggtggtggctgctgct

SEQ ID NO: 17694 - DNA, 20 bp, Artificial Sequence
  Description of Artificial Sequence: Synthetic oligonucleotide
  Target: SOD1; (+) strand; PAM type: YTN; PAM sequence: CTG
ctgctgctgctgctgctgtg

SEQ ID NO: 17695 - DNA, 20 bp, Artificial Sequence
  Description of Artificial Sequence: Synthetic oligonucleotide
  Target: SOD1; (+) strand; PAM type: YTN; PAM sequence: CTG
ctgctgctgctgctgtggtt

SEQ ID NO: 17696 - DNA, 20 bp, Artificial Sequence
  Description of Artificial Sequence: Synthetic oligonucleotide
  Target: SOD1; (+) strand; PAM type: YTN; PAM sequence: CTG
ctgctgctgctgtggttgct

SEQ ID NO: 17697 - DNA, 20 bp, Artificial Sequence
  Description of Artificial Sequence: Synthetic oligonucleotide
  Target: SOD1; (+) strand; PAM type: YTN; PAM sequence: CTG
ctgctgctgtggttgctggg

SEQ ID NO: 17698 - DNA, 20 bp, Artificial Sequence
  Description of Artificial Sequence: Synthetic oligonucleotide
  Target: SOD1; (+) strand; PAM type: YTN; PAM sequence: CTG
ctgctgtggttgctggggcg

SEQ ID NO: 17699 - DNA, 20 bp, Artificial Sequence
  Description of Artificial Sequence: Synthetic oligonucleotide
  Target: SOD1; (+) strand; PAM type: YTN; PAM sequence: CTG
ctgtggttgctggggcgcct

SEQ ID NO: 17700 - DNA, 20 bp, Artificial Sequence
  Description of Artificial Sequence: Synthetic oligonucleotide
  Target: SOD1; (+) strand; PAM type: YTN; PAM sequence: CTG
tggttgctggggcgcctgcg

SEQ ID NO: 17701 - DNA, 20 bp, Artificial Sequence
  Description of Artificial Sequence: Synthetic oligonucleotide
  Target: SOD1; (+) strand; PAM type: YTN; PAM sequence: TTG
ctggggcgcctgcggctgtg

SEQ ID NO: 17702 - DNA, 20 bp, Artificial Sequence
  Description of Artificial Sequence: Synthetic oligonucleotide
  Target: SOD1; (+) strand; PAM type: YTN; PAM sequence: CTG
gggcgcctgcggctgtggct

SEQ ID NO: 17703 - DNA, 20 bp, Artificial Sequence
  Description of Artificial Sequence: Synthetic oligonucleotide
  Target: SOD1; (+) strand; PAM type: YTN; PAM sequence: CTG
cggctgtggctgctgctgtg

SEQ ID NO: 17704 - DNA, 20 bp, Artificial Sequence
  Description of Artificial Sequence: Synthetic oligonucleotide
  Target: SOD1; (+) strand; PAM type: YTN; PAM sequence: CTG
tggctgctgctgtggctgct

SEQ ID NO: 17705 - DNA, 20 bp, Artificial Sequence
  Description of Artificial Sequence: Synthetic oligonucleotide
  Target: SOD1; (+) strand; PAM type: YTN; PAM sequence: CTG
ctgctgtggctgctgcggcg

SEQ ID NO: 17706 - DNA, 20 bp, Artificial Sequence
  Description of Artificial Sequence: Synthetic oligonucleotide
  Target: SOD1; (+) strand; PAM type: YTN; PAM sequence: CTG
ctgtggctgctgcggcggct

SEQ ID NO: 17707 - DNA, 20 bp, Artificial Sequence
  Description of Artificial Sequence: Synthetic oligonucleotide
  Target: SOD1; (+) strand; PAM type: YTN; PAM sequence: CTG
tggctgctgcggcggctgtt

SEQ ID NO: 17708 - DNA, 20 bp, Artificial Sequence
  Description of Artificial Sequence: Synthetic oligonucleotide
  Target: SOD1; (+) strand; PAM type: YTN; PAM sequence: CTG
ctgcggcggctgttgccttc

SEQ ID NO: 17709 - DNA, 20 bp, Artificial Sequence
  Description of Artificial Sequence: Synthetic oligonucleotide
  Target: SOD1; (+) strand; PAM type: YTN; PAM sequence: CTG
cggcggctgttgccttccgt

SEQ ID NO: 17710 - DNA, 20 bp, Artificial Sequence
  Description of Artificial Sequence: Synthetic oligonucleotide
  Target: SOD1; (+) strand; PAM type: YTN; PAM sequence: CTG
ttgccttccgtctctgtctt

SEQ ID NO: 17711 - DNA, 20 bp, Artificial Sequence
  Description of Artificial Sequence: Synthetic oligonucleotide
  Target: SOD1; (+) strand; PAM type: YTN; PAM sequence: TTG
ccttccgtctctgtcttcag

SEQ ID NO: 17712 - DNA, 20 bp, Artificial Sequence
  Description of Artificial Sequence: Synthetic oligonucleotide
  Target: SOD1; (+) strand; PAM type: YTN; PAM sequence: CTT
ccgtctctgtcttcaggacc

SEQ ID NO: 17713 - DNA, 20 bp, Artificial Sequence
  Description of Artificial Sequence: Synthetic oligonucleotide
  Target: SOD1; (+) strand; PAM type: YTN; PAM sequence: TTC
cgtctctgtcttcaggaccc

SEQ ID NO: 17714 - DNA, 20 bp, Artificial Sequence
  Description of Artificial Sequence: Synthetic oligonucleotide
  Target: SOD1; (+) strand; PAM type: YTN; PAM sequence: CTC
tgtcttcaggaccccctggg

SEQ ID NO: 17715 - DNA, 20 bp, Artificial Sequence
  Description of Artificial Sequence: Synthetic oligonucleotide
  Target: SOD1; (+) strand; PAM type: YTN; PAM sequence: CTG
tcttcaggaccccctgggcc

SEQ ID NO: 17716 - DNA, 20 bp, Artificial Sequence
  Description of Artificial Sequence: Synthetic oligonucleotide
  Target: SOD1; (+) strand; PAM type: YTN; PAM sequence: CTT
caggaccccctgggcctggc

SEQ ID NO: 17717 - DNA, 20 bp, Artificial Sequence
  Description of Artificial Sequence: Synthetic oligonucleotide
  Target: SOD1; (+) strand; PAM type: YTN; PAM sequence: TTC
aggaccccctgggcctggcc

SEQ ID NO: 17718 - DNA, 20 bp, Artificial Sequence
  Description of Artificial Sequence: Synthetic oligonucleotide
  Target: SOD1; (+) strand; PAM type: YTN; PAM sequence: CTG
ggcctggccctgggcccccg

SEQ ID NO: 17719 - DNA, 20 bp, Artificial Sequence
  Description of Artificial Sequence: Synthetic oligonucleotide
  Target: SOD1; (+) strand; PAM type: YTN; PAM sequence: CTG
gccctgggcccccgagccct

SEQ ID NO: 17720 - DNA, 20 bp, Artificial Sequence
  Description of Artificial Sequence: Synthetic oligonucleotide
  Target: SOD1; (+) strand; PAM type: YTN; PAM sequence: CTG
ggcccccgagccctggcatt

SEQ ID NO: 17721 - DNA, 20 bp, Artificial Sequence
  Description of Artificial Sequence: Synthetic oligonucleotide
  Target: SOD1; (+) strand; PAM type: YTN; PAM sequence: CTG
gcattccaccaggcctaaca

SEQ ID NO: 17722 - DNA, 20 bp, Artificial Sequence
  Description of Artificial Sequence: Synthetic oligonucleotide
  Target: SOD1; (+) strand; PAM type: YTN; PAM sequence: TTC
caccaggcctaacaaagggg

SEQ ID NO: 17723 - DNA, 20 bp, Artificial Sequence
  Description of Artificial Sequence: Synthetic oligonucleotide
  Target: SOD1; (+) strand; PAM type: YTN; PAM sequence: CTA
acaaaggggccatgcggtgg

SEQ ID NO: 17724 - DNA, 20 bp, Artificial Sequence
  Description of Artificial Sequence: Synthetic oligonucleotide
  Target: SOD1; (+) strand; PAM type: YTN; PAM sequence: CTT
tcattccatgaggtggaggc

SEQ ID NO: 17725 - DNA, 20 bp, Artificial Sequence
  Description of Artificial Sequence: Synthetic oligonucleotide
  Target: SOD1; (+) strand; PAM type: YTN; PAM sequence: TTT
cattccatgaggtggaggca

SEQ ID NO: 17726 - DNA, 20 bp, Artificial Sequence
  Description of Artificial Sequence: Synthetic oligonucleotide
  Target: SOD1; (+) strand; PAM type: YTN; PAM sequence: TTC
attccatgaggtggaggcat

SEQ ID NO: 17727 - DNA, 20 bp, Artificial Sequence
  Description of Artificial Sequence: Synthetic oligonucleotide
  Target: SOD1; (+) strand; PAM type: YTN; PAM sequence: TTC
catgaggtggaggcatcgca

SEQ ID NO: 17728 - DNA, 20 bp, Artificial Sequence
  Description of Artificial Sequence: Synthetic oligonucleotide
  Target: SOD1; (+) strand; PAM type: YTN; PAM sequence: CTG
gtcctggcggtgggcctctg

SEQ ID NO: 17729 - DNA, 20 bp, Artificial Sequence
  Description of Artificial Sequence: Synthetic oligonucleotide
  Target: SOD1; (+) strand; PAM type: YTN; PAM sequence: CTG
gcggtgggcctctgtgcatc

SEQ ID NO: 17730 - DNA, 20 bp, Artificial Sequence
  Description of Artificial Sequence: Synthetic oligonucleotide
  Target: SOD1; (+) strand; PAM type: YTN; PAM sequence: CTC
tgtgcatcatgtgcggtggc

SEQ ID NO: 17731 - DNA, 20 bp, Artificial Sequence
  Description of Artificial Sequence: Synthetic oligonucleotide
  Target: SOD1; (+) strand; PAM type: YTN; PAM sequence: CTG
tgcatcatgtgcggtggcat

SEQ ID NO: 17732 - DNA, 20 bp, Artificial Sequence
  Description of Artificial Sequence: Synthetic oligonucleotide
  Target: SOD1; (+) strand; PAM type: YTN; PAM sequence: CTG
taagtgaggtgggggcattc

SEQ ID NO: 17733 - DNA, 20 bp, Artificial Sequence
  Description of Artificial Sequence: Synthetic oligonucleotide
  Target: SOD1; (+) strand; PAM type: YTN; PAM sequence: TTC
ctggagggcgctggagtggg

SEQ ID NO: 17734 - DNA, 20 bp, Artificial Sequence
  Description of Artificial Sequence: Synthetic oligonucleotide
  Target: SOD1; (+) strand; PAM type: YTN; PAM sequence: CTG
gagggcgctggagtgggatg

SEQ ID NO: 17735 - DNA, 20 bp, Artificial Sequence
  Description of Artificial Sequence: Synthetic oligonucleotide
  Target: SOD1; (+) strand; PAM type: YTN; PAM sequence: CTG
gagtgggatgagaccgggcc

SEQ ID NO: 17736 - DNA, 20 bp, Artificial Sequence
  Description of Artificial Sequence: Synthetic oligonucleotide
  Target: SOD1; (+) strand; PAM type: YTN; PAM sequence: CTG
aagtccaattacaggaccag

SEQ ID NO: 17737 - DNA, 20 bp, Artificial Sequence
  Description of Artificial Sequence: Synthetic oligonucleotide
  Target: SOD1; (+) strand; PAM type: YTN; PAM sequence: TTA
caggaccaggggcaactcct

SEQ ID NO: 17738 - DNA, 20 bp, Artificial Sequence
  Description of Artificial Sequence: Synthetic oligonucleotide
  Target: SOD1; (+) strand; PAM type: YTN; PAM sequence: CTC
cttgagtgcctaaaagacga

SEQ ID NO: 17739 - DNA, 20 bp, Artificial Sequence
  Description of Artificial Sequence: Synthetic oligonucleotide
  Target: SOD1; (+) strand; PAM type: YTN; PAM sequence: CTT
gagtgcctaaaagacgacaa

SEQ ID NO: 17740 - DNA, 20 bp, Artificial Sequence
  Description of Artificial Sequence: Synthetic oligonucleotide
  Target: SOD1; (+) strand; PAM type: YTN; PAM sequence: TTG
agtgcctaaaagacgacaaa

SEQ ID NO: 17741 - DNA, 20 bp, Artificial Sequence
  Description of Artificial Sequence: Synthetic oligonucleotide
  Target: SOD1; (+) strand; PAM type: YTN; PAM sequence: CTA
aaagacgacaaaaataaaaa

SEQ ID NO: 17742 - DNA, 20 bp, Artificial Sequence
  Description of Artificial Sequence: Synthetic oligonucleotide
  Target: SOD1; (+) strand; PAM type: YTN; PAM sequence: CTC
cagtttcagctgtgttctgt

SEQ ID NO: 17743 - DNA, 20 bp, Artificial Sequence
  Description of Artificial Sequence: Synthetic oligonucleotide
  Target: SOD1; (+) strand; PAM type: YTN; PAM sequence: TTT
cagctgtgttctgtggcgct

SEQ ID NO: 17744 - DNA, 20 bp, Artificial Sequence
  Description of Artificial Sequence: Synthetic oligonucleotide
  Target: SOD1; (+) strand; PAM type: YTN; PAM sequence: TTC
agctgtgttctgtggcgctt

SEQ ID NO: 17745 - DNA, 20 bp, Artificial Sequence
  Description of Artificial Sequence: Synthetic oligonucleotide
  Target: SOD1; (+) strand; PAM type: YTN; PAM sequence: CTG
tgttctgtggcgcttaaagc

SEQ ID NO: 17746 - DNA, 20 bp, Artificial Sequence
  Description of Artificial Sequence: Synthetic oligonucleotide
  Target: SOD1; (+) strand; PAM type: YTN; PAM sequence: TTC
tgtggcgcttaaagcaaaat

SEQ ID NO: 17747 - DNA, 20 bp, Artificial Sequence
  Description of Artificial Sequence: Synthetic oligonucleotide
  Target: SOD1; (+) strand; PAM type: YTN; PAM sequence: CTG
tggcgcttaaagcaaaataa

SEQ ID NO: 17748 - DNA, 20 bp, Artificial Sequence
  Description of Artificial Sequence: Synthetic oligonucleotide
  Target: SOD1; (+) strand; PAM type: YTN; PAM sequence: CTT
aaagcaaaataaaattcaac

SEQ ID NO: 17749 - DNA, 20 bp, Artificial Sequence
  Description of Artificial Sequence: Synthetic oligonucleotide
  Target: SOD1; (+) strand; PAM type: YTN; PAM sequence: TTA
aagcaaaataaaattcaacc

SEQ ID NO: 17750 - DNA, 20 bp, Artificial Sequence
  Description of Artificial Sequence: Synthetic oligonucleotide
  Target: SOD1; (+) strand; PAM type: YTN; PAM sequence: TTC
aacccacaatcttcaaattt

SEQ ID NO: 17751 - DNA, 20 bp, Artificial Sequence
  Description of Artificial Sequence: Synthetic oligonucleotide
  Target: SOD1; (+) strand; PAM type: YTN; PAM sequence: CTT
caaatttcatagtttgccac

SEQ ID NO: 17752 - DNA, 20 bp, Artificial Sequence
  Description of Artificial Sequence: Synthetic oligonucleotide
  Target: SOD1; (+) strand; PAM type: YTN; PAM sequence: TTC
aaatttcatagtttgccact

SEQ ID NO: 17753 - DNA, 20 bp, Artificial Sequence
  Description of Artificial Sequence: Synthetic oligonucleotide
  Target: SOD1; (+) strand; PAM type: YTN; PAM sequence: TTT
catagtttgccactctgtca

SEQ ID NO: 17754 - DNA, 20 bp, Artificial Sequence
  Description of Artificial Sequence: Synthetic oligonucleotide
  Target: SOD1; (+) strand; PAM type: YTN; PAM sequence: TTC
atagtttgccactctgtcac

SEQ ID NO: 17755 - DNA, 20 bp, Artificial Sequence
  Description of Artificial Sequence: Synthetic oligonucleotide
  Target: SOD1; (+) strand; PAM type: YTN; PAM sequence: TTT
gccactctgtcacaaaccca

SEQ ID NO: 17756 - DNA, 20 bp, Artificial Sequence
  Description of Artificial Sequence: Synthetic oligonucleotide
  Target: SOD1; (+) strand; PAM type: YTN; PAM sequence: TTG
ccactctgtcacaaacccag

SEQ ID NO: 17757 - DNA, 20 bp, Artificial Sequence
  Description of Artificial Sequence: Synthetic oligonucleotide
  Target: SOD1; (+) strand; PAM type: YTN; PAM sequence: CTC
tgtcacaaacccagtgtgag

SEQ ID NO: 17758 - DNA, 20 bp, Artificial Sequence
  Description of Artificial Sequence: Synthetic oligonucleotide
  Target: SOD1; (+) strand; PAM type: YTN; PAM sequence: CTG
tcacaaacccagtgtgaggc

SEQ ID NO: 17759 - DNA, 20 bp, Artificial Sequence
  Description of Artificial Sequence: Synthetic oligonucleotide
  Target: SOD1; (+) strand; PAM type: YTN; PAM sequence: CTA
gtaacaacctaaggcaagca

SEQ ID NO: 17760 - DNA, 20 bp, Artificial Sequence
  Description of Artificial Sequence: Synthetic oligonucleotide
  Target: SOD1; (+) strand; PAM type: YTN; PAM sequence: CTA
aggcaagcaattgcaaagac

SEQ ID NO: 17761 - DNA, 20 bp, Artificial Sequence
  Description of Artificial Sequence: Synthetic oligonucleotide
  Target: SOD1; (+) strand; PAM type: YTN; PAM sequence: TTG
caaagacatttttaaagtat

SEQ ID NO: 17762 - DNA, 20 bp, Artificial Sequence
  Description of Artificial Sequence: Synthetic oligonucleotide
  Target: SOD1; (+) strand; PAM type: YTN; PAM sequence: TTT
ttaaagtatctaatacaggt

SEQ ID NO: 17763 - DNA, 20 bp, Artificial Sequence
  Description of Artificial Sequence: Synthetic oligonucleotide
  Target: SOD1; (+) strand; PAM type: YTN; PAM sequence: TTT
taaagtatctaatacaggta

SEQ ID NO: 17764 - DNA, 20 bp, Artificial Sequence
  Description of Artificial Sequence: Synthetic oligonucleotide
  Target: SOD1; (+) strand; PAM type: YTN; PAM sequence: TTT
aaagtatctaatacaggtag

SEQ ID NO: 17765 - DNA, 20 bp, Artificial Sequence
  Description of Artificial Sequence: Synthetic oligonucleotide
  Target: SOD1; (+) strand; PAM type: YTN; PAM sequence: TTA
aagtatctaatacaggtaga

SEQ ID NO: 17766 - DNA, 20 bp, Artificial Sequence
  Description of Artificial Sequence: Synthetic oligonucleotide
  Target: SOD1; (+) strand; PAM type: YTN; PAM sequence: CTA
atacaggtagaggccagaat

SEQ ID NO: 17767 - DNA, 20 bp, Artificial Sequence
  Description of Artificial Sequence: Synthetic oligonucleotide
  Target: SOD1; (+) strand; PAM type: YTN; PAM sequence: CTG
ggaaataaaatagtaatggt

SEQ ID NO: 17768 - DNA, 20 bp, Artificial Sequence
  Description of Artificial Sequence: Synthetic oligonucleotide
  Target: SOD1; (+) strand; PAM type: YTN; PAM sequence: TTT
tcaaagagtatgtcaaaatc

SEQ ID NO: 17769 - DNA, 20 bp, Artificial Sequence
  Description of Artificial Sequence: Synthetic oligonucleotide
  Target: SOD1; (+) strand; PAM type: YTN; PAM sequence: TTT
caaagagtatgtcaaaatct

SEQ ID NO: 17770 - DNA, 20 bp, Artificial Sequence
  Description of Artificial Sequence: Synthetic oligonucleotide
  Target: SOD1; (+) strand; PAM type: YTN; PAM sequence: TTC
aaagagtatgtcaaaatctc

SEQ ID NO: 17771 - DNA, 20 bp, Artificial Sequence
  Description of Artificial Sequence: Synthetic oligonucleotide
  Target: SOD1; (+) strand; PAM type: YTN; PAM sequence: CTC
ctgtagctttcattagaagc

SEQ ID NO: 17772 - DNA, 20 bp, Artificial Sequence
  Description of Artificial Sequence: Synthetic oligonucleotide
  Target: SOD1; (+) strand; PAM type: YTN; PAM sequence: CTG
tagctttcattagaagctgt

SEQ ID NO: 17773 - DNA, 20 bp, Artificial Sequence
  Description of Artificial Sequence: Synthetic oligonucleotide
  Target: SOD1; (+) strand; PAM type: YTN; PAM sequence: CTT
tcattagaagctgtcttccc

SEQ ID NO: 17774 - DNA, 20 bp, Artificial Sequence
  Description of Artificial Sequence: Synthetic oligonucleotide
  Target: SOD1; (+) strand; PAM type: YTN; PAM sequence: TTT
cattagaagctgtcttccca

SEQ ID NO: 17775 - DNA, 20 bp, Artificial Sequence
  Description of Artificial Sequence: Synthetic oligonucleotide
  Target: SOD1; (+) strand; PAM type: YTN; PAM sequence: TTC
attagaagctgtcttcccac

SEQ ID NO: 17776 - DNA, 20 bp, Artificial Sequence
  Description of Artificial Sequence: Synthetic oligonucleotide
  Target: SOD1; (+) strand; PAM type: YTN; PAM sequence: TTA
gaagctgtcttcccactcca

SEQ ID NO: 17777 - DNA, 20 bp, Artificial Sequence
  Description of Artificial Sequence: Synthetic oligonucleotide
  Target: SOD1; (+) strand; PAM type: YTN; PAM sequence: CTG
tcttcccactccaaatacat

SEQ ID NO: 17778 - DNA, 20 bp, Artificial Sequence
  Description of Artificial Sequence: Synthetic oligonucleotide
  Target: SOD1; (+) strand; PAM type: YTN; PAM sequence: CTT
cccactccaaatacatttga

SEQ ID NO: 17779 - DNA, 20 bp, Artificial Sequence
  Description of Artificial Sequence: Synthetic oligonucleotide
  Target: SOD1; (+) strand; PAM type: YTN; PAM sequence: TTC
ccactccaaatacatttgag

SEQ ID NO: 17780 - DNA, 20 bp, Artificial Sequence
  Description of Artificial Sequence: Synthetic oligonucleotide
  Target: SOD1; (+) strand; PAM type: YTN; PAM sequence: CTC
caaatacatttgagaaacac

SEQ ID NO: 17781 - DNA, 20 bp, Artificial Sequence
  Description of Artificial Sequence: Synthetic oligonucleotide
  Target: SOD1; (+) strand; PAM type: YTN; PAM sequence: TTT
gagaaacacagtgtgctaag

SEQ ID NO: 17782 - DNA, 20 bp, Artificial Sequence
  Description of Artificial Sequence: Synthetic oligonucleotide
  Target: SOD1; (+) strand; PAM type: YTN; PAM sequence: TTG
agaaacacagtgtgctaagt

SEQ ID NO: 17783 - DNA, 20 bp, Artificial Sequence
  Description of Artificial Sequence: Synthetic oligonucleotide
  Target: SOD1; (+) strand; PAM type: YTN; PAM sequence: CTA
agtcctaatgagataaatac

SEQ ID NO: 17784 - DNA, 20 bp, Artificial Sequence
  Description of Artificial Sequence: Synthetic oligonucleotide
  Target: SOD1; (+) strand; PAM type: YTN; PAM sequence: CTA
atgagataaatacattcact

SEQ ID NO: 17785 - DNA, 20 bp, Artificial Sequence
  Description of Artificial Sequence: Synthetic oligonucleotide
  Target: SOD1; (+) strand; PAM type: YTN; PAM sequence: TTC
actatcagtaactattcaag

SEQ ID NO: 17786 - DNA, 20 bp, Artificial Sequence
  Description of Artificial Sequence: Synthetic oligonucleotide
  Target: SOD1; (+) strand; PAM type: YTN; PAM sequence: CTA
tcagtaactattcaagctaa

SEQ ID NO: 17787 - DNA, 20 bp, Artificial Sequence
  Description of Artificial Sequence: Synthetic oligonucleotide
  Target: SOD1; (+) strand; PAM type: YTN; PAM sequence: CTA
ttcaagctaactaagcatac

SEQ ID NO: 17788 - DNA, 20 bp, Artificial Sequence
  Description of Artificial Sequence: Synthetic oligonucleotide
  Target: SOD1; (+) strand; PAM type: YTN; PAM sequence: TTC
aagctaactaagcatactgc

SEQ ID NO: 17789 - DNA, 20 bp, Artificial Sequence
  Description of Artificial Sequence: Synthetic oligonucleotide
  Target: SOD1; (+) strand; PAM type: YTN; PAM sequence: CTA
actaagcatactgcaggtgc

SEQ ID NO: 17790 - DNA, 20 bp, Artificial Sequence
  Description of Artificial Sequence: Synthetic oligonucleotide
  Target: SOD1; (+) strand; PAM type: YTN; PAM sequence: CTA
agcatactgcaggtgcacac

SEQ ID NO: 17791 - DNA, 20 bp, Artificial Sequence
  Description of Artificial Sequence: Synthetic oligonucleotide
  Target: SOD1; (+) strand; PAM type: YTN; PAM sequence: CTG
caggtgcacacttagaaaat

SEQ ID NO: 17792 - DNA, 20 bp, Artificial Sequence
  Description of Artificial Sequence: Synthetic oligonucleotide
  Target: SOD1; (+) strand; PAM type: YTN; PAM sequence: CTT
agaaaatttacaccccgtct

SEQ ID NO: 17793 - DNA, 20 bp, Artificial Sequence
  Description of Artificial Sequence: Synthetic oligonucleotide
  Target: SOD1; (+) strand; PAM type: YTN; PAM sequence: TTA
gaaaatttacaccccgtctt

SEQ ID NO: 17794 - DNA, 20 bp, Artificial Sequence
  Description of Artificial Sequence: Synthetic oligonucleotide
  Target: SOD1; (+) strand; PAM type: YTN; PAM sequence: TTT
acaccccgtcttattactag

SEQ ID NO: 17795 - DNA, 20 bp, Artificial Sequence
  Description of Artificial Sequence: Synthetic oligonucleotide
  Target: SOD1; (+) strand; PAM type: YTN; PAM sequence: TTA
caccccgtcttattactaga

SEQ ID NO: 17796 - DNA, 20 bp, Artificial Sequence
  Description of Artificial Sequence: Synthetic oligonucleotide
  Target: SOD1; (+) strand; PAM type: YTN; PAM sequence: CTT
attactagaaaaaaatgagg

SEQ ID NO: 17797 - DNA, 20 bp, Artificial Sequence
  Description of Artificial Sequence: Synthetic oligonucleotide
  Target: SOD1; (+) strand; PAM type: YTN; PAM sequence: TTA
ttactagaaaaaaatgaggt

SEQ ID NO: 17798 - DNA, 20 bp, Artificial Sequence
  Description of Artificial Sequence: Synthetic oligonucleotide
  Target: SOD1; (+) strand; PAM type: YTN; PAM sequence: TTA
ctagaaaaaaatgaggtcac

SEQ ID NO: 17799 - DNA, 20 bp, Artificial Sequence
  Description of Artificial Sequence: Synthetic oligonucleotide
  Target: SOD1; (+) strand; PAM type: YTN; PAM sequence: CTA
gaaaaaaatgaggtcactga

SEQ ID NO: 17800 - DNA, 20 bp, Artificial Sequence
  Description of Artificial Sequence: Synthetic oligonucleotide
  Target: SOD1; (+) strand; PAM type: YTN; PAM sequence: CTG
acctagaaaacccaggaaag

SEQ ID NO: 17801 - DNA, 20 bp, Artificial Sequence
  Description of Artificial Sequence: Synthetic oligonucleotide
  Target: SOD1; (+) strand; PAM type: YTN; PAM sequence: CTA
gaaaacccaggaaagaggaa

SEQ ID NO: 17802 - DNA, 20 bp, Artificial Sequence
  Description of Artificial Sequence: Synthetic oligonucleotide
  Target: SOD1; (+) strand; PAM type: YTN; PAM sequence: CTC
tttgactccatgctacactt

SEQ ID NO: 17803 - DNA, 20 bp, Artificial Sequence
  Description of Artificial Sequence: Synthetic oligonucleotide
  Target: SOD1; (+) strand; PAM type: YTN; PAM sequence: CTT
tgactccatgctacacttag

SEQ ID NO: 17804 - DNA, 20 bp, Artificial Sequence
  Description of Artificial Sequence: Synthetic oligonucleotide
  Target: SOD1; (+) strand; PAM type: YTN; PAM sequence: TTT
gactccatgctacacttagt

SEQ ID NO: 17805 - DNA, 20 bp, Artificial Sequence
  Description of Artificial Sequence: Synthetic oligonucleotide
  Target: SOD1; (+) strand; PAM type: YTN; PAM sequence: TTG
actccatgctacacttagtc

SEQ ID NO: 17806 - DNA, 20 bp, Artificial Sequence
  Description of Artificial Sequence: Synthetic oligonucleotide
  Target: SOD1; (+) strand; PAM type: YTN; PAM sequence: CTC
catgctacacttagtccata

SEQ ID NO: 17807 - DNA, 20 bp, Artificial Sequence
  Description of Artificial Sequence: Synthetic oligonucleotide
  Target: SOD1; (+) strand; PAM type: YTN; PAM sequence: CTA
cacttagtccatattattaa

SEQ ID NO: 17808 - DNA, 20 bp, Artificial Sequence
  Description of Artificial Sequence: Synthetic oligonucleotide
  Target: SOD1; (+) strand; PAM type: YTN; PAM sequence: CTT
agtccatattattaaaatgc

SEQ ID NO: 17809 - DNA, 20 bp, Artificial Sequence
  Description of Artificial Sequence: Synthetic oligonucleotide
  Target: SOD1; (+) strand; PAM type: YTN; PAM sequence: TTA
gtccatattattaaaatgcc

SEQ ID NO: 17810 - DNA, 20 bp, Artificial Sequence
  Description of Artificial Sequence: Synthetic oligonucleotide
  Target: SOD1; (+) strand; PAM type: YTN; PAM sequence: TTA
ttaaaatgcctcatgcagtt

SEQ ID NO: 17811 - DNA, 20 bp, Artificial Sequence
  Description of Artificial Sequence: Synthetic oligonucleotide
  Target: SOD1; (+) strand; PAM type: YTN; PAM sequence: TTA
aaatgcctcatgcagttact

SEQ ID NO: 17812 - DNA, 20 bp, Artificial Sequence
  Description of Artificial Sequence: Synthetic oligonucleotide
  Target: SOD1; (+) strand; PAM type: YTN; PAM sequence: CTC
atgcagttactatgcaatgt

SEQ ID NO: 17813 - DNA, 20 bp, Artificial Sequence
  Description of Artificial Sequence: Synthetic oligonucleotide
  Target: SOD1; (+) strand; PAM type: YTN; PAM sequence: TTA
ctatgcaatgtgcatcaaat

SEQ ID NO: 17814 - DNA, 20 bp, Artificial Sequence
  Description of Artificial Sequence: Synthetic oligonucleotide
  Target: SOD1; (+) strand; PAM type: YTN; PAM sequence: CTA
tgcaatgtgcatcaaataaa

SEQ ID NO: 17815 - DNA, 20 bp, Artificial Sequence
  Description of Artificial Sequence: Synthetic oligonucleotide
  Target: SOD1; (+) strand; PAM type: YTN; PAM sequence: CTA
atgtctacaaaacaaagatc

SEQ ID NO: 17816 - DNA, 20 bp, Artificial Sequence
  Description of Artificial Sequence: Synthetic oligonucleotide
  Target: SOD1; (+) strand; PAM type: YTN; PAM sequence: CTA
caaaacaaagatccatacac

SEQ ID NO: 17817 - DNA, 20 bp, Artificial Sequence
  Description of Artificial Sequence: Synthetic oligonucleotide
  Target: SOD1; (+) strand; PAM type: YTN; PAM sequence: TTT
actgttacagttcctttttc

SEQ ID NO: 17818 - DNA, 20 bp, Artificial Sequence
  Description of Artificial Sequence: Synthetic oligonucleotide
  Target: SOD1; (+) strand; PAM type: YTN; PAM sequence: TTA
ctgttacagttcctttttca

SEQ ID NO: 17819 - DNA, 20 bp, Artificial Sequence
  Description of Artificial Sequence: Synthetic oligonucleotide
  Target: SOD1; (+) strand; PAM type: YTN; PAM sequence: CTG
ttacagttcctttttcaagg

SEQ ID NO: 17820 - DNA, 20 bp, Artificial Sequence
  Description of Artificial Sequence: Synthetic oligonucleotide
  Target: SOD1; (+) strand; PAM type: YTN; PAM sequence: TTA
cagttcctttttcaaggcac

SEQ ID NO: 17821 - DNA, 20 bp, Artificial Sequence
  Description of Artificial Sequence: Synthetic oligonucleotide
  Target: SOD1; (+) strand; PAM type: YTN; PAM sequence: TTC
ctttttcaaggcacagcatg

SEQ ID NO: 17822 - DNA, 20 bp, Artificial Sequence
  Description of Artificial Sequence: Synthetic oligonucleotide
  Target: SOD1; (+) strand; PAM type: YTN; PAM sequence: CTT
tttcaaggcacagcatgata

SEQ ID NO: 17823 - DNA, 20 bp, Artificial Sequence
  Description of Artificial Sequence: Synthetic oligonucleotide
  Target: SOD1; (+) strand; PAM type: YTN; PAM sequence: TTT
ttcaaggcacagcatgatat

SEQ ID NO: 17824 - DNA, 20 bp, Artificial Sequence
  Description of Artificial Sequence: Synthetic oligonucleotide
  Target: SOD1; (+) strand; PAM type: YTN; PAM sequence: TTT
tcaaggcacagcatgatatt

SEQ ID NO: 17825 - DNA, 20 bp, Artificial Sequence
  Description of Artificial Sequence: Synthetic oligonucleotide
  Target: SOD1; (+) strand; PAM type: YTN; PAM sequence: TTT
caaggcacagcatgatattt

SEQ ID NO: 17826 - DNA, 20 bp, Artificial Sequence
  Description of Artificial Sequence: Synthetic oligonucleotide
  Target: SOD1; (+) strand; PAM type: YTN; PAM sequence: TTC
aaggcacagcatgatattta

SEQ ID NO: 17827 - DNA, 20 bp, Artificial Sequence
  Description of Artificial Sequence: Synthetic oligonucleotide
  Target: SOD1; (+) strand; PAM type: YTN; PAM sequence: TTT
aacttgcgaggccatcacga

SEQ ID NO: 17828 - DNA, 20 bp, Artificial Sequence
  Description of Artificial Sequence: Synthetic oligonucleotide
  Target: SOD1; (+) strand; PAM type: YTN; PAM sequence: TTA
acttgcgaggccatcacgac

SEQ ID NO: 17829 - DNA, 20 bp, Artificial Sequence
  Description of Artificial Sequence: Synthetic oligonucleotide
  Target: SOD1; (+) strand; PAM type: YTN; PAM sequence: CTT
gcgaggccatcacgacctga

SEQ ID NO: 17830 - DNA, 20 bp, Artificial Sequence
  Description of Artificial Sequence: Synthetic oligonucleotide
  Target: SOD1; (+) strand; PAM type: YTN; PAM sequence: TTG
cgaggccatcacgacctgaa

SEQ ID NO: 17831 - DNA, 20 bp, Artificial Sequence
  Description of Artificial Sequence: Synthetic oligonucleotide
  Target: SOD1; (+) strand; PAM type: YTN; PAM sequence: CTG
aataatgctcaatgttcagc

SEQ ID NO: 17832 - DNA, 20 bp, Artificial Sequence
  Description of Artificial Sequence: Synthetic oligonucleotide
  Target: SOD1; (+) strand; PAM type: YTN; PAM sequence: CTC
aatgttcagctgttcacctt

SEQ ID NO: 17833 - DNA, 20 bp, Artificial Sequence
  Description of Artificial Sequence: Synthetic oligonucleotide
  Target: SOD1; (+) strand; PAM type: YTN; PAM sequence: TTC
agctgttcaccttctattca

SEQ ID NO: 17834 - DNA, 20 bp, Artificial Sequence
  Description of Artificial Sequence: Synthetic oligonucleotide
  Target: SOD1; (+) strand; PAM type: YTN; PAM sequence: CTG
ttcaccttctattcattatt

SEQ ID NO: 17835 - DNA, 20 bp, Artificial Sequence
  Description of Artificial Sequence: Synthetic oligonucleotide
  Target: SOD1; (+) strand; PAM type: YTN; PAM sequence: TTC
accttctattcattatttct

SEQ ID NO: 17836 - DNA, 20 bp, Artificial Sequence
  Description of Artificial Sequence: Synthetic oligonucleotide
  Target: SOD1; (+) strand; PAM type: YTN; PAM sequence: CTT
ctattcattatttctattca

SEQ ID NO: 17837 - DNA, 20 bp, Artificial Sequence
  Description of Artificial Sequence: Synthetic oligonucleotide
  Target: SOD1; (+) strand; PAM type: YTN; PAM sequence: TTC
tattcattatttctattcat

SEQ ID NO: 17838 - DNA, 20 bp, Artificial Sequence
  Description of Artificial Sequence: Synthetic oligonucleotide
  Target: SOD1; (+) strand; PAM type: YTN; PAM sequence: CTA
ttcattatttctattcattc

SEQ ID NO: 17839 - DNA, 20 bp, Artificial Sequence
  Description of Artificial Sequence: Synthetic oligonucleotide
  Target: SOD1; (+) strand; PAM type: YTN; PAM sequence: TTC
attatttctattcattcttc

SEQ ID NO: 17840 - DNA, 20 bp, Artificial Sequence
  Description of Artificial Sequence: Synthetic oligonucleotide
  Target: SOD1; (+) strand; PAM type: YTN; PAM sequence: TTA
tttctattcattcttccaaa

SEQ ID NO: 17841 - DNA, 20 bp, Artificial Sequence
  Description of Artificial Sequence: Synthetic oligonucleotide
  Target: SOD1; (+) strand; PAM type: YTN; PAM sequence: TTT
ctattcattcttccaaaggt

SEQ ID NO: 17842 - DNA, 20 bp, Artificial Sequence
  Description of Artificial Sequence: Synthetic oligonucleotide
  Target: SOD1; (+) strand; PAM type: YTN; PAM sequence: TTC
tattcattcttccaaaggtg

SEQ ID NO: 17843 - DNA, 20 bp, Artificial Sequence
  Description of Artificial Sequence: Synthetic oligonucleotide
  Target: SOD1; (+) strand; PAM type: YTN; PAM sequence: CTA
ttcattcttccaaaggtggc

SEQ ID NO: 17844 - DNA, 20 bp, Artificial Sequence
  Description of Artificial Sequence: Synthetic oligonucleotide
  Target: SOD1; (+) strand; PAM type: YTN; PAM sequence: TTC
attcttccaaaggtggcaag

SEQ ID NO: 17845 - DNA, 20 bp, Artificial Sequence
  Description of Artificial Sequence: Synthetic oligonucleotide
  Target: SOD1; (+) strand; PAM type: YTN; PAM sequence: TTC
ttccaaaggtggcaagtctg

SEQ ID NO: 17846 - DNA, 20 bp, Artificial Sequence
  Description of Artificial Sequence: Synthetic oligonucleotide
  Target: SOD1; (+) strand; PAM type: YTN; PAM sequence: CTT
ccaaaggtggcaagtctggt

SEQ ID NO: 17847 - DNA, 20 bp, Artificial Sequence
  Description of Artificial Sequence: Synthetic oligonucleotide
  Target: SOD1; (+) strand; PAM type: YTN; PAM sequence: TTC
caaaggtggcaagtctggta

SEQ ID NO: 17848 - DNA, 20 bp, Artificial Sequence
  Description of Artificial Sequence: Synthetic oligonucleotide
  Target: SOD1; (+) strand; PAM type: YTN; PAM sequence: CTG
gtaaggttggtgctgctgaa

SEQ ID NO: 17849 - DNA, 20 bp, Artificial Sequence
  Description of Artificial Sequence: Synthetic oligonucleotide
  Target: SOD1; (+) strand; PAM type: YTN; PAM sequence: TTG
gtgctgctgaaataacaatg

SEQ ID NO: 17850 - DNA, 20 bp, Artificial Sequence
  Description of Artificial Sequence: Synthetic oligonucleotide
  Target: SOD1; (+) strand; PAM type: YTN; PAM sequence: CTG
ctgaaataacaatgacttct

SEQ ID NO: 17851 - DNA, 20 bp, Artificial Sequence
  Description of Artificial Sequence: Synthetic oligonucleotide
  Target: SOD1; (+) strand; PAM type: YTN; PAM sequence: CTG
aaataacaatgacttcttgg

SEQ ID NO: 17852 - DNA, 20 bp, Artificial Sequence
  Description of Artificial Sequence: Synthetic oligonucleotide
  Target: SOD1; (+) strand; PAM type: YTN; PAM sequence: CTT
cttggttttattttcctatc

SEQ ID NO: 17853 - DNA, 20 bp, Artificial Sequence
  Description of Artificial Sequence: Synthetic oligonucleotide
  Target: SOD1; (+) strand; PAM type: YTN; PAM sequence: TTC
ttggttttattttcctatct

SEQ ID NO: 17854 - DNA, 20 bp, Artificial Sequence
  Description of Artificial Sequence: Synthetic oligonucleotide
  Target: SOD1; (+) strand; PAM type: YTN; PAM sequence: CTT
ggttttattttcctatctac

SEQ ID NO: 17855 - DNA, 20 bp, Artificial Sequence
  Description of Artificial Sequence: Synthetic oligonucleotide
  Target: SOD1; (+) strand; PAM type: YTN; PAM sequence: TTG
gttttattttcctatctaca

SEQ ID NO: 17856 - DNA, 20 bp, Artificial Sequence
  Description of Artificial Sequence: Synthetic oligonucleotide
  Target: SOD1; (+) strand; PAM type: YTN; PAM sequence: TTT
tattttcctatctacatgag

SEQ ID NO: 17857 - DNA, 20 bp, Artificial Sequence
  Description of Artificial Sequence: Synthetic oligonucleotide
  Target: SOD1; (+) strand; PAM type: YTN; PAM sequence: TTT
attttcctatctacatgagg

SEQ ID NO: 17858 - DNA, 20 bp, Artificial Sequence
  Description of Artificial Sequence: Synthetic oligonucleotide
  Target: SOD1; (+) strand; PAM type: YTN; PAM sequence: TTA
ttttcctatctacatgaggg

SEQ ID NO: 17859 - DNA, 20 bp, Artificial Sequence
  Description of Artificial Sequence: Synthetic oligonucleotide
  Target: SOD1; (+) strand; PAM type: YTN; PAM sequence: TTT
tcctatctacatgagggttt

SEQ ID NO: 17860 - DNA, 20 bp, Artificial Sequence
  Description of Artificial Sequence: Synthetic oligonucleotide
  Target: SOD1; (+) strand; PAM type: YTN; PAM sequence: TTT
cctatctacatgagggtttg

SEQ ID NO: 17861 - DNA, 20 bp, Artificial Sequence
  Description of Artificial Sequence: Synthetic oligonucleotide
  Target: SOD1; (+) strand; PAM type: YTN; PAM sequence: TTC
ctatctacatgagggtttgc

SEQ ID NO: 17862 - DNA, 20 bp, Artificial Sequence
  Description of Artificial Sequence: Synthetic oligonucleotide
  Target: SOD1; (+) strand; PAM type: YTN; PAM sequence: CTA
tctacatgagggtttgctca

SEQ ID NO: 17863 - DNA, 20 bp, Artificial Sequence
  Description of Artificial Sequence: Synthetic oligonucleotide
  Target: SOD1; (+) strand; PAM type: YTN; PAM sequence: CTA
catgagggtttgctcatact

SEQ ID NO: 17864 - DNA, 20 bp, Artificial Sequence
  Description of Artificial Sequence: Synthetic oligonucleotide
  Target: SOD1; (+) strand; PAM type: YTN; PAM sequence: TTT
gctcatactgatataagagt

SEQ ID NO: 17865 - DNA, 20 bp, Artificial Sequence
  Description of Artificial Sequence: Synthetic oligonucleotide
  Target: SOD1; (+) strand; PAM type: YTN; PAM sequence: TTG
ctcatactgatataagagtc

SEQ ID NO: 17866 - DNA, 20 bp, Artificial Sequence
  Description of Artificial Sequence: Synthetic oligonucleotide
  Target: SOD1; (+) strand; PAM type: YTN; PAM sequence: CTC
atactgatataagagtcacg

SEQ ID NO: 17867 - DNA, 20 bp, Artificial Sequence
  Description of Artificial Sequence: Synthetic oligonucleotide
  Target: SOD1; (+) strand; PAM type: YTN; PAM sequence: CTG
atataagagtcacgcaagtt

SEQ ID NO: 17868 - DNA, 20 bp, Artificial Sequence
  Description of Artificial Sequence: Synthetic oligonucleotide
  Target: SOD1; (+) strand; PAM type: YTN; PAM sequence: TTC
aacaacctgtcattttctgc

SEQ ID NO: 17869 - DNA, 20 bp, Artificial Sequence
  Description of Artificial Sequence: Synthetic oligonucleotide
  Target: SOD1; (+) strand; PAM type: YTN; PAM sequence: CTG
tcattttctgcttggggttc

SEQ ID NO: 17870 - DNA, 20 bp, Artificial Sequence
  Description of Artificial Sequence: Synthetic oligonucleotide
  Target: SOD1; (+) strand; PAM type: YTN; PAM sequence: TTT
tctgcttggggttcaccact

SEQ ID NO: 17871 - DNA, 20 bp, Artificial Sequence
  Description of Artificial Sequence: Synthetic oligonucleotide
  Target: SOD1; (+) strand; PAM type: YTN; PAM sequence: TTT
ctgcttggggttcaccactt

SEQ ID NO: 17872 - DNA, 20 bp, Artificial Sequence
  Description of Artificial Sequence: Synthetic oligonucleotide
  Target: SOD1; (+) strand; PAM type: YTN; PAM sequence: TTC
tgcttggggttcaccactta

SEQ ID NO: 17873 - DNA, 20 bp, Artificial Sequence
  Description of Artificial Sequence: Synthetic oligonucleotide
  Target: SOD1; (+) strand; PAM type: YTN; PAM sequence: CTG
cttggggttcaccacttagg

SEQ ID NO: 17874 - DNA, 20 bp, Artificial Sequence
  Description of Artificial Sequence: Synthetic oligonucleotide
  Target: SOD1; (+) strand; PAM type: YTN; PAM sequence: CTT
ggggttcaccacttaggtac

SEQ ID NO: 17875 - DNA, 20 bp, Artificial Sequence
  Description of Artificial Sequence: Synthetic oligonucleotide
  Target: SOD1; (+) strand; PAM type: YTN; PAM sequence: TTG
gggttcaccacttaggtaca

SEQ ID NO: 17876 - DNA, 20 bp, Artificial Sequence
  Description of Artificial Sequence: Synthetic oligonucleotide
  Target: SOD1; (+) strand; PAM type: YTN; PAM sequence: TTC
accacttaggtacagaaaag

SEQ ID NO: 17877 - DNA, 20 bp, Artificial Sequence
  Description of Artificial Sequence: Synthetic oligonucleotide
  Target: SOD1; (+) strand; PAM type: YTN; PAM sequence: CTT
aggtacagaaaagcattgga

SEQ ID NO: 17878 - DNA, 20 bp, Artificial Sequence
  Description of Artificial Sequence: Synthetic oligonucleotide
  Target: SOD1; (+) strand; PAM type: YTN; PAM sequence: TTA
ggtacagaaaagcattggaa

SEQ ID NO: 17879 - DNA, 20 bp, Artificial Sequence
  Description of Artificial Sequence: Synthetic oligonucleotide
  Target: SOD1; (+) strand; PAM type: YTN; PAM sequence: TTG
gaatctctcaatttatcctt

SEQ ID NO: 17880 - DNA, 20 bp, Artificial Sequence
  Description of Artificial Sequence: Synthetic oligonucleotide
  Target: SOD1; (+) strand; PAM type: YTN; PAM sequence: CTC
tcaatttatccttttgcaaa

SEQ ID NO: 17881 - DNA, 20 bp, Artificial Sequence
  Description of Artificial Sequence: Synthetic oligonucleotide
  Target: SOD1; (+) strand; PAM type: YTN; PAM sequence: CTC
aatttatccttttgcaaata

SEQ ID NO: 17882 - DNA, 20 bp, Artificial Sequence
  Description of Artificial Sequence: Synthetic oligonucleotide
  Target: SOD1; (+) strand; PAM type: YTN; PAM sequence: TTT
atccttttgcaaatataaat

SEQ ID NO: 17883 - DNA, 20 bp, Artificial Sequence
  Description of Artificial Sequence: Synthetic oligonucleotide
  Target: SOD1; (+) strand; PAM type: YTN; PAM sequence: TTA
tccttttgcaaatataaata

SEQ ID NO: 17884 - DNA, 20 bp, Artificial Sequence
  Description of Artificial Sequence: Synthetic oligonucleotide
  Target: SOD1; (+) strand; PAM type: YTN; PAM sequence: CTT
ttgcaaatataaataagaca

SEQ ID NO: 17885 - DNA, 20 bp, Artificial Sequence
  Description of Artificial Sequence: Synthetic oligonucleotide
  Target: SOD1; (+) strand; PAM type: YTN; PAM sequence: TTT
tgcaaatataaataagacaa

SEQ ID NO: 17886 - DNA, 20 bp, Artificial Sequence
  Description of Artificial Sequence: Synthetic oligonucleotide
  Target: SOD1; (+) strand; PAM type: YTN; PAM sequence: TTT
gcaaatataaataagacaaa

SEQ ID NO: 17887 - DNA, 20 bp, Artificial Sequence
  Description of Artificial Sequence: Synthetic oligonucleotide
  Target: SOD1; (+) strand; PAM type: YTN; PAM sequence: TTG
caaatataaataagacaaat

SEQ ID NO: 17888 - DNA, 20 bp, Artificial Sequence
  Description of Artificial Sequence: Synthetic oligonucleotide
  Target: SOD1; (+) strand; PAM type: YTN; PAM sequence: CTA
taatactatgattgaaagga

SEQ ID NO: 17889 - DNA, 20 bp, Artificial Sequence
  Description of Artificial Sequence: Synthetic oligonucleotide
  Target: SOD1; (+) strand; PAM type: YTN; PAM sequence: CTA
tgattgaaaggagttattct

SEQ ID NO: 17890 - DNA, 20 bp, Artificial Sequence
  Description of Artificial Sequence: Synthetic oligonucleotide
  Target: SOD1; (+) strand; PAM type: YTN; PAM sequence: TTG
aaaggagttattctgataat

SEQ ID NO: 17891 - DNA, 20 bp, Artificial Sequence
  Description of Artificial Sequence: Synthetic oligonucleotide
  Target: SOD1; (+) strand; PAM type: YTN; PAM sequence: TTA
ttctgataatggaaaatgtt

SEQ ID NO: 17892 - DNA, 20 bp, Artificial Sequence
  Description of Artificial Sequence: Synthetic oligonucleotide
  Target: SOD1; (+) strand; PAM type: YTN; PAM sequence: TTC
tgataatggaaaatgttcca

SEQ ID NO: 17893 - DNA, 20 bp, Artificial Sequence
  Description of Artificial Sequence: Synthetic oligonucleotide
  Target: SOD1; (+) strand; PAM type: YTN; PAM sequence: CTG
ataatggaaaatgttccagg

SEQ ID NO: 17894 - DNA, 20 bp, Artificial Sequence
  Description of Artificial Sequence: Synthetic oligonucleotide
  Target: SOD1; (+) strand; PAM type: YTN; PAM sequence: TTC
caggtactgttaagaacatg

SEQ ID NO: 17895 - DNA, 20 bp, Artificial Sequence
  Description of Artificial Sequence: Synthetic oligonucleotide
  Target: SOD1; (+) strand; PAM type: YTN; PAM sequence: CTG
ttaagaacatgctatttacc

SEQ ID NO: 17896 - DNA, 20 bp, Artificial Sequence
  Description of Artificial Sequence: Synthetic oligonucleotide
  Target: SOD1; (+) strand; PAM type: YTN; PAM sequence: TTA
agaacatgctatttacccat

SEQ ID NO: 17897 - DNA, 20 bp, Artificial Sequence
  Description of Artificial Sequence: Synthetic oligonucleotide
  Target: SOD1; (+) strand; PAM type: YTN; PAM sequence: CTA
tttacccatgtgctgcagaa

SEQ ID NO: 17898 - DNA, 20 bp, Artificial Sequence
  Description of Artificial Sequence: Synthetic oligonucleotide
  Target: SOD1; (+) strand; PAM type: YTN; PAM sequence: TTT
acccatgtgctgcagaaagg

SEQ ID NO: 17899 - DNA, 20 bp, Artificial Sequence
  Description of Artificial Sequence: Synthetic oligonucleotide
  Target: SOD1; (+) strand; PAM type: YTN; PAM sequence: TTA
cccatgtgctgcagaaaggt

SEQ ID NO: 17900 - DNA, 20 bp, Artificial Sequence
  Description of Artificial Sequence: Synthetic oligonucleotide
  Target: SOD1; (+) strand; PAM type: YTN; PAM sequence: CTG
cagaaaggtctttgagcaag

SEQ ID NO: 17901 - DNA, 20 bp, Artificial Sequence
  Description of Artificial Sequence: Synthetic oligonucleotide
  Target: SOD1; (+) strand; PAM type: YTN; PAM sequence: CTT
tgagcaagttatgggttatg

SEQ ID NO: 17902 - DNA, 20 bp, Artificial Sequence
  Description of Artificial Sequence: Synthetic oligonucleotide
  Target: SOD1; (+) strand; PAM type: YTN; PAM sequence: TTT
gagcaagttatgggttatga

SEQ ID NO: 17903 - DNA, 20 bp, Artificial Sequence
  Description of Artificial Sequence: Synthetic oligonucleotide
  Target: SOD1; (+) strand; PAM type: YTN; PAM sequence: TTG
agcaagttatgggttatgat

SEQ ID NO: 17904 - DNA, 20 bp, Artificial Sequence
  Description of Artificial Sequence: Synthetic oligonucleotide
  Target: SOD1; (+) strand; PAM type: YTN; PAM sequence: TTA
tgggttatgatcagttagca

SEQ ID NO: 17905 - DNA, 20 bp, Artificial Sequence
  Description of Artificial Sequence: Synthetic oligonucleotide
  Target: SOD1; (+) strand; PAM type: YTN; PAM sequence: TTA
tgatcagttagcaatggtaa

SEQ ID NO: 17906 - DNA, 20 bp, Artificial Sequence
  Description of Artificial Sequence: Synthetic oligonucleotide
  Target: SOD1; (+) strand; PAM type: YTN; PAM sequence: TTA
gcaatggtaagaaaaatact

SEQ ID NO: 17907 - DNA, 20 bp, Artificial Sequence
  Description of Artificial Sequence: Synthetic oligonucleotide
  Target: SOD1; (+) strand; PAM type: YTN; PAM sequence: CTT
gggtgacactgacagaaaaa

SEQ ID NO: 17908 - DNA, 20 bp, Artificial Sequence
  Description of Artificial Sequence: Synthetic oligonucleotide
  Target: SOD1; (+) strand; PAM type: YTN; PAM sequence: TTG
ggtgacactgacagaaaaat

SEQ ID NO: 17909 - DNA, 20 bp, Artificial Sequence
  Description of Artificial Sequence: Synthetic oligonucleotide
  Target: SOD1; (+) strand; PAM type: YTN; PAM sequence: CTG
acagaaaaatgaccaattgg

SEQ ID NO: 17910 - DNA, 20 bp, Artificial Sequence
  Description of Artificial Sequence: Synthetic oligonucleotide
  Target: SOD1; (+) strand; PAM type: YTN; PAM sequence: TTG
ggaaatgctgattaccacag

SEQ ID NO: 17911 - DNA, 20 bp, Artificial Sequence
  Description of Artificial Sequence: Synthetic oligonucleotide
  Target: SOD1; (+) strand; PAM type: YTN; PAM sequence: CTG
attaccacagcaaaagcgcc

SEQ ID NO: 17912 - DNA, 20 bp, Artificial Sequence
  Description of Artificial Sequence: Synthetic oligonucleotide
  Target: SOD1; (+) strand; PAM type: YTN; PAM sequence: TTA
ccacagcaaaagcgccagaa

SEQ ID NO: 17913 - DNA, 20 bp, Artificial Sequence
  Description of Artificial Sequence: Synthetic oligonucleotide
  Target: SOD1; (+) strand; PAM type: YTN; PAM sequence: TTG
tgaaatggatgaggtgatgg

SEQ ID NO: 17914 - DNA, 20 bp, Artificial Sequence
  Description of Artificial Sequence: Synthetic oligonucleotide
  Target: SOD1; (+) strand; PAM type: YTN; PAM sequence: CTC
tgtcccttcacaggctcttc

SEQ ID NO: 17915 - DNA, 20 bp, Artificial Sequence
  Description of Artificial Sequence: Synthetic oligonucleotide
  Target: SOD1; (+) strand; PAM type: YTN; PAM sequence: CTG
tcccttcacaggctcttcag

SEQ ID NO: 17916 - DNA, 20 bp, Artificial Sequence
  Description of Artificial Sequence: Synthetic oligonucleotide
  Target: SOD1; (+) strand; PAM type: YTN; PAM sequence: CTT
cacaggctcttcagacactt

SEQ ID NO: 17917 - DNA, 20 bp, Artificial Sequence
  Description of Artificial Sequence: Synthetic oligonucleotide
  Target: SOD1; (+) strand; PAM type: YTN; PAM sequence: TTC
acaggctcttcagacacttt

SEQ ID NO: 17918 - DNA, 20 bp, Artificial Sequence
  Description of Artificial Sequence: Synthetic oligonucleotide
  Target: SOD1; (+) strand; PAM type: YTN; PAM sequence: CTC
ttcagacactttgggaaaat

SEQ ID NO: 17919 - DNA, 20 bp, Artificial Sequence
  Description of Artificial Sequence: Synthetic oligonucleotide
  Target: SOD1; (+) strand; PAM type: YTN; PAM sequence: CTT
cagacactttgggaaaatcc

SEQ ID NO: 17920 - DNA, 20 bp, Artificial Sequence
  Description of Artificial Sequence: Synthetic oligonucleotide
  Target: SOD1; (+) strand; PAM type: YTN; PAM sequence: TTC
agacactttgggaaaatccc

SEQ ID NO: 17921 - DNA, 20 bp, Artificial Sequence
  Description of Artificial Sequence: Synthetic oligonucleotide
  Target: SOD1; (+) strand; PAM type: YTN; PAM sequence: CTT
tgggaaaatcccaatgaaca

SEQ ID NO: 17922 - DNA, 20 bp, Artificial Sequence
  Description of Artificial Sequence: Synthetic oligonucleotide
  Target: SOD1; (+) strand; PAM type: YTN; PAM sequence: TTT
gggaaaatcccaatgaacaa

SEQ ID NO: 17923 - DNA, 20 bp, Artificial Sequence
  Description of Artificial Sequence: Synthetic oligonucleotide
  Target: SOD1; (+) strand; PAM type: YTN; PAM sequence: TTG
ggaaaatcccaatgaacaag

SEQ ID NO: 17924 - DNA, 20 bp, Artificial Sequence
  Description of Artificial Sequence: Synthetic oligonucleotide
  Target: SOD1; (+) strand; PAM type: YTN; PAM sequence: CTA
cactgtatctcagatagaaa

SEQ ID NO: 17925 - DNA, 20 bp, Artificial Sequence
  Description of Artificial Sequence: Synthetic oligonucleotide
  Target: SOD1; (+) strand; PAM type: YTN; PAM sequence: CTG
tatctcagatagaaataaaa

SEQ ID NO: 17926 - DNA, 20 bp, Artificial Sequence
  Description of Artificial Sequence: Synthetic oligonucleotide
  Target: SOD1; (+) strand; PAM type: YTN; PAM sequence: CTC
agatagaaataaaacactct

SEQ ID NO: 17927 - DNA, 20 bp, Artificial Sequence
  Description of Artificial Sequence: Synthetic oligonucleotide
  Target: SOD1; (+) strand; PAM type: YTN; PAM sequence: CTC
ttcacatcatttgggaaata

SEQ ID NO: 17928 - DNA, 20 bp, Artificial Sequence
  Description of Artificial Sequence: Synthetic oligonucleotide
  Target: SOD1; (+) strand; PAM type: YTN; PAM sequence: CTT
cacatcatttgggaaatatt

SEQ ID NO: 17929 - DNA, 20 bp, Artificial Sequence
  Description of Artificial Sequence: Synthetic oligonucleotide
  Target: SOD1; (+) strand; PAM type: YTN; PAM sequence: TTC
acatcatttgggaaatattt

SEQ ID NO: 17930 - DNA, 20 bp, Artificial Sequence
  Description of Artificial Sequence: Synthetic oligonucleotide
  Target: SOD1; (+) strand; PAM type: YTN; PAM sequence: TTT
gggaaatatttaccgagtat

SEQ ID NO: 17931 - DNA, 20 bp, Artificial Sequence
  Description of Artificial Sequence: Synthetic oligonucleotide
  Target: SOD1; (+) strand; PAM type: YTN; PAM sequence: TTG
ggaaatatttaccgagtata

SEQ ID NO: 17932 - DNA, 20 bp, Artificial Sequence
  Description of Artificial Sequence: Synthetic oligonucleotide
  Target: SOD1; (+) strand; PAM type: YTN; PAM sequence: TTT
accgagtatataccatacac

SEQ ID NO: 17933 - DNA, 20 bp, Artificial Sequence
  Description of Artificial Sequence: Synthetic oligonucleotide
  Target: SOD1; (+) strand; PAM type: YTN; PAM sequence: TTA
ccgagtatataccatacact

SEQ ID NO: 17934 - DNA, 20 bp, Artificial Sequence
  Description of Artificial Sequence: Synthetic oligonucleotide
  Target: SOD1; (+) strand; PAM type: YTN; PAM sequence: CTG
gggcaacagaagcacatgtc

SEQ ID NO: 17935 - DNA, 20 bp, Artificial Sequence
  Description of Artificial Sequence: Synthetic oligonucleotide
  Target: SOD1; (+) strand; PAM type: YTN; PAM sequence: CTT
gctttcactttgtaaagaaa

SEQ ID NO: 17936 - DNA, 20 bp, Artificial Sequence
  Description of Artificial Sequence: Synthetic oligonucleotide
  Target: SOD1; (+) strand; PAM type: YTN; PAM sequence: TTG
ctttcactttgtaaagaaat

SEQ ID NO: 17937 - DNA, 20 bp, Artificial Sequence
  Description of Artificial Sequence: Synthetic oligonucleotide
  Target: SOD1; (+) strand; PAM type: YTN; PAM sequence: CTT
tcactttgtaaagaaatagt

SEQ ID NO: 17938 - DNA, 20 bp, Artificial Sequence
  Description of Artificial Sequence: Synthetic oligonucleotide
  Target: SOD1; (+) strand; PAM type: YTN; PAM sequence: TTT
cactttgtaaagaaatagtg

SEQ ID NO: 17939 - DNA, 20 bp, Artificial Sequence
  Description of Artificial Sequence: Synthetic oligonucleotide
  Target: SOD1; (+) strand; PAM type: YTN; PAM sequence: TTC
actttgtaaagaaatagtgt

SEQ ID NO: 17940 - DNA, 20 bp, Artificial Sequence
  Description of Artificial Sequence: Synthetic oligonucleotide
  Target: SOD1; (+) strand; PAM type: YTN; PAM sequence: CTT
tgtaaagaaatagtgtagtt

SEQ ID NO: 17941 - DNA, 20 bp, Artificial Sequence
  Description of Artificial Sequence: Synthetic oligonucleotide
  Target: SOD1; (+) strand; PAM type: YTN; PAM sequence: TTT
gtaaagaaatagtgtagttc

SEQ ID NO: 17942 - DNA, 20 bp, Artificial Sequence
  Description of Artificial Sequence: Synthetic oligonucleotide
  Target: SOD1; (+) strand; PAM type: YTN; PAM sequence: TTG
taaagaaatagtgtagttcc

SEQ ID NO: 17943 - DNA, 20 bp, Artificial Sequence
  Description of Artificial Sequence: Synthetic oligonucleotide
  Target: SOD1; (+) strand; PAM type: YTN; PAM sequence: TTC
caacacctgtggactttaat

SEQ ID NO: 17944 - DNA, 20 bp, Artificial Sequence
  Description of Artificial Sequence: Synthetic oligonucleotide
  Target: SOD1; (+) strand; PAM type: YTN; PAM sequence: CTG
tggactttaatccaaaacat

SEQ ID NO: 17945 - DNA, 20 bp, Artificial Sequence
  Description of Artificial Sequence: Synthetic oligonucleotide
  Target: SOD1; (+) strand; PAM type: YTN; PAM sequence: CTT
taatccaaaacataaaatgt

SEQ ID NO: 17946 - DNA, 20 bp, Artificial Sequence
  Description of Artificial Sequence: Synthetic oligonucleotide
  Target: SOD1; (+) strand; PAM type: YTN; PAM sequence: TTT
aatccaaaacataaaatgta

SEQ ID NO: 17947 - DNA, 20 bp, Artificial Sequence
  Description of Artificial Sequence: Synthetic oligonucleotide
  Target: SOD1; (+) strand; PAM type: YTN; PAM sequence: TTA
atccaaaacataaaatgtat

SEQ ID NO: 17948 - DNA, 20 bp, Artificial Sequence
  Description of Artificial Sequence: Synthetic oligonucleotide
  Target: SOD1; (+) strand; PAM type: YTN; PAM sequence: CTC
ttttaatagagggatcatta

SEQ ID NO: 17949 - DNA, 20 bp, Artificial Sequence
  Description of Artificial Sequence: Synthetic oligonucleotide
  Target: SOD1; (+) strand; PAM type: YTN; PAM sequence: CTT
ttaatagagggatcattata

SEQ ID NO: 17950 - DNA, 20 bp, Artificial Sequence
  Description of Artificial Sequence: Synthetic oligonucleotide
  Target: SOD1; (+) strand; PAM type: YTN; PAM sequence: TTT
taatagagggatcattatat

SEQ ID NO: 17951 - DNA, 20 bp, Artificial Sequence
  Description of Artificial Sequence: Synthetic oligonucleotide
  Target: SOD1; (+) strand; PAM type: YTN; PAM sequence: TTT
aatagagggatcattatata

SEQ ID NO: 17952 - DNA, 20 bp, Artificial Sequence
  Description of Artificial Sequence: Synthetic oligonucleotide
  Target: SOD1; (+) strand; PAM type: YTN; PAM sequence: TTA
atagagggatcattatatag

SEQ ID NO: 17953 - DNA, 20 bp, Artificial Sequence
  Description of Artificial Sequence: Synthetic oligonucleotide
  Target: SOD1; (+) strand; PAM type: YTN; PAM sequence: TTA
tatagaaacacctgaaacaa

SEQ ID NO: 17954 - DNA, 20 bp, Artificial Sequence
  Description of Artificial Sequence: Synthetic oligonucleotide
  Target: SOD1; (+) strand; PAM type: YTN; PAM sequence: CTG
aaacaaactgaactttactt

SEQ ID NO: 17955 - DNA, 20 bp, Artificial Sequence
  Description of Artificial Sequence: Synthetic oligonucleotide
  Target: SOD1; (+) strand; PAM type: YTN; PAM sequence: CTG
aactttactttcccattacc

SEQ ID NO: 17956 - DNA, 20 bp, Artificial Sequence
  Description of Artificial Sequence: Synthetic oligonucleotide
  Target: SOD1; (+) strand; PAM type: YTN; PAM sequence: CTT
tactttcccattacctttta

SEQ ID NO: 17957 - DNA, 20 bp, Artificial Sequence
  Description of Artificial Sequence: Synthetic oligonucleotide
  Target: SOD1; (+) strand; PAM type: YTN; PAM sequence: TTT
actttcccattaccttttat

SEQ ID NO: 17958 - DNA, 20 bp, Artificial Sequence
  Description of Artificial Sequence: Synthetic oligonucleotide
  Target: SOD1; (+) strand; PAM type: YTN; PAM sequence: TTA
ctttcccattaccttttatc

SEQ ID NO: 17959 - DNA, 20 bp, Artificial Sequence
  Description of Artificial Sequence: Synthetic oligonucleotide
  Target: SOD1; (+) strand; PAM type: YTN; PAM sequence: CTT
tcccattaccttttatcagt

SEQ ID NO: 17960 - DNA, 20 bp, Artificial Sequence
  Description of Artificial Sequence: Synthetic oligonucleotide
  Target: SOD1; (+) strand; PAM type: YTN; PAM sequence: TTT
cccattaccttttatcagta

SEQ ID NO: 17961 - DNA, 20 bp, Artificial Sequence
  Description of Artificial Sequence: Synthetic oligonucleotide
  Target: SOD1; (+) strand; PAM type: YTN; PAM sequence: TTC
ccattaccttttatcagtaa

SEQ ID NO: 17962 - DNA, 20 bp, Artificial Sequence
  Description of Artificial Sequence: Synthetic oligonucleotide
  Target: SOD1; (+) strand; PAM type: YTN; PAM sequence: TTA
ccttttatcagtaaagattt

SEQ ID NO: 17963 - DNA, 20 bp, Artificial Sequence
  Description of Artificial Sequence: Synthetic oligonucleotide
  Target: SOD1; (+) strand; PAM type: YTN; PAM sequence: CTT
ttatcagtaaagatttgttt

SEQ ID NO: 17964 - DNA, 20 bp, Artificial Sequence
  Description of Artificial Sequence: Synthetic oligonucleotide
  Target: SOD1; (+) strand; PAM type: YTN; PAM sequence: TTT
tatcagtaaagatttgtttt

SEQ ID NO: 17965 - DNA, 20 bp, Artificial Sequence
  Description of Artificial Sequence: Synthetic oligonucleotide
  Target: SOD1; (+) strand; PAM type: YTN; PAM sequence: TTT
atcagtaaagatttgttttc

SEQ ID NO: 17966 - DNA, 20 bp, Artificial Sequence
  Description of Artificial Sequence: Synthetic oligonucleotide
  Target: SOD1; (+) strand; PAM type: YTN; PAM sequence: TTA
tcagtaaagatttgttttcc

SEQ ID NO: 17967 - DNA, 20 bp, Artificial Sequence
  Description of Artificial Sequence: Synthetic oligonucleotide
  Target: SOD1; (+) strand; PAM type: YTN; PAM sequence: TTT
gttttccaggactaaaatga

SEQ ID NO: 17968 - DNA, 20 bp, Artificial Sequence
  Description of Artificial Sequence: Synthetic oligonucleotide
  Target: SOD1; (+) strand; PAM type: YTN; PAM sequence: TTG
ttttccaggactaaaatgac

SEQ ID NO: 17969 - DNA, 20 bp, Artificial Sequence
  Description of Artificial Sequence: Synthetic oligonucleotide
  Target: SOD1; (+) strand; PAM type: YTN; PAM sequence: TTT
tccaggactaaaatgaccaa

SEQ ID NO: 17970 - DNA, 20 bp, Artificial Sequence
  Description of Artificial Sequence: Synthetic oligonucleotide
  Target: SOD1; (+) strand; PAM type: YTN; PAM sequence: TTT
ccaggactaaaatgaccaat

SEQ ID NO: 17971 - DNA, 20 bp, Artificial Sequence
  Description of Artificial Sequence: Synthetic oligonucleotide
  Target: SOD1; (+) strand; PAM type: YTN; PAM sequence: TTC
caggactaaaatgaccaatg

SEQ ID NO: 17972 - DNA, 20 bp, Artificial Sequence
  Description of Artificial Sequence: Synthetic oligonucleotide
  Target: SOD1; (+) strand; PAM type: YTN; PAM sequence: CTA
aaatgaccaatgtttactgt

SEQ ID NO: 17973 - DNA, 20 bp, Artificial Sequence
  Description of Artificial Sequence: Synthetic oligonucleotide
  Target: SOD1; (+) strand; PAM type: YTN; PAM sequence: TTT
actgttaacggaggtcagca

SEQ ID NO: 17974 - DNA, 20 bp, Artificial Sequence
  Description of Artificial Sequence: Synthetic oligonucleotide
  Target: SOD1; (+) strand; PAM type: YTN; PAM sequence: TTA
ctgttaacggaggtcagcat

SEQ ID NO: 17975 - DNA, 20 bp, Artificial Sequence
  Description of Artificial Sequence: Synthetic oligonucleotide
  Target: SOD1; (+) strand; PAM type: YTN; PAM sequence: CTG
ttaacggaggtcagcataga

SEQ ID NO: 17976 - DNA, 20 bp, Artificial Sequence
  Description of Artificial Sequence: Synthetic oligonucleotide
  Target: SOD1; (+) strand; PAM type: YTN; PAM sequence: TTA
acggaggtcagcatagaaca

SEQ ID NO: 17977-18006 - skipped (30 entries)

SEQ ID NO: 18007 - DNA, 23 bp, Artificial Sequence
  Description of Artificial Sequence: Synthetic oligonucleotide
  modified_base (1)..(21): a, c, t, g, unknown or other
nnnnnnnnnnnnnnnnnnnnnrg

SEQ ID NO: 18008 - RNA, 100 nt, Artificial Sequence
  chemically synthesized
  modified_base (1)..(20): n is a, c, g, u, or other
nnnnnnnnnnnnnnnnnnnnguuuuagagcuagaaauagcaaguuaaaauaaggcuaguccguuaucaacuugaaaaaguggcaccgagucggugcuuuu

SEQ ID NO: 18009 - RNA, 96 nt, Artificial Sequence
  chemically synthesized
  modified_base (1)..(20): n is a, c, g, u, or other
nnnnnnnnnnnnnnnnnnnnguuuuagagcuagaaauagcaaguuaaaauaaggcuaguccguuaucaacuugaaaaaguggcaccgagucggugc

SEQ ID NO: 18010 - RNA, 114 nt, Artificial Sequence
  chemically synthesized
  modified_base (1)..(30): n is a, c, g, u, or other and this region may encompass 17-30 nucleotides;
  modified_base (107)..(114): This region may encompass 1-8 urasil;
nnnnnnnnnnnnnnnnnnnnnnnnnnnnnnguuuuagagcuagaaauagcaaguuaaaauaaggcuaguccguuaucaacuugaaaaaguggcaccgagucggugcuuuuuuuu
